(12) United States Patent
Mori et al.

(10) Patent No.: US 7,820,436 B2
(45) Date of Patent: Oct. 26, 2010

(54) RECOMBINANT VIRAL VECTOR FOR GENE TRANSFER INTO LYMPHOID CELLS

(75) Inventors: Yasuko Mori, Ibaraki (JP); Kenjiro Tadagaki, Suita (JP); Masaya Takemoto, Suita (JP); Michlaki Takahashi, Suita (JP); Koichi Yamanishi, Osaka (JP)

(73) Assignee: The Research Foundation for Microbial Diseases of Osaka University, Osaka (JP)

( * ) Notice: Subject to any disclaimer, the term of this patent is extended or adjusted under 35 U.S.C. 154(b) by 0 days.

(21) Appl. No.: 12/437,644

(22) Filed: May 8, 2009

(65) Prior Publication Data

US 2009/0253208 A1 Oct. 8, 2009

Related U.S. Application Data

(63) Continuation of application No. 10/843,877, filed on May 12, 2004, now abandoned.

(30) Foreign Application Priority Data

May 6, 2004 (JP) ............................. 2004-137953

(51) Int. Cl.
*C12N 15/00* (2006.01)
(52) U.S. Cl. .................................. 435/320.1
(58) Field of Classification Search ............... None
See application file for complete search history.

(56) References Cited

U.S. PATENT DOCUMENTS

| 6,573,090 B1 | 6/2003 | Breakefield et al. |
| 7,223,411 B1 | 5/2007 | Knipe et al. |
| 2003/0165537 A1 | 9/2003 | Fehler et al. |
| 2005/0106733 A1 | 5/2005 | Takada et al. |

FOREIGN PATENT DOCUMENTS

| WO | WO 00/50603 A1 | 8/2000 |
| WO | WO 02/081712 A2 | 10/2002 |
| WO | WO 02/092826 A2 | 11/2002 |
| WO | WO 03/056023 A1 | 7/2003 |

OTHER PUBLICATIONS

Adler, H. et al., "Cloning and mutagenesis of the murine gammaherpesvirus 68 genome as an infectious bacterial artificial chromosome", *Journal of Virology*, 74(15):6964-6974 (2000).
Frenkel, N. et al., "Isolation of a new herpesvirus from human CD4+ T cells", Proc Natl. Acad. Sci., 87(2):748-752 (1990).
Jia, Q. et al., "Murine gammaherpesvirus 68 open reading frame 31 is required for viral replication", *Journal of Virology*, 78(12):6610-6620 (2004).
Messerle, M. et al., "Cloning and mutagenesis of a herpesvirus genome as an infectious bacterial artificial chromosome", *Proc. Natl. Acad. Sci. USA*, 94:14759-14763 (1997).
Nicholas, John "Determination and analysis of the complete nucleotide sequence of human herpesvirus", *Proc Natl. Acad. Sci.*, 70(9):5975-5989 (1996).
Tanaka, K. et al., "Human herpesvirus 7: another casual agent for roseola (exanthem subitum)", *The Journal of Pediatrics*, 125(1):1-5 (1994).
Tanaka-Taya, K. et al., "Seroepidemiological study of human herpesvirus-6 and -7 in children of different ages and detection of these two viruses in throat swabs by polymerase chain reaction", *Journal of Medical Virology*, 48(1):88-94 (1996).
Tanaka, K. et al., "Construction of an excisable bacterial artificial chromosome containing a full-length infectious clone of herpes simplex virus type 1: viruses reconstituted from the clone exhibit wild-type properties in vitro and in vivo", *Journal of Virology*, 77(2):1382-1391 (2003).
Yamanishi, K. et al., "Identification of human herpesvirus-6 as a casual agent for exanthem subitum", *The Lancet*, 1(8594):1065-1067 (1988).

*Primary Examiner*—Ali R. Salimi
(74) *Attorney, Agent, or Firm*—King & Spalding LLP; Susan J. Myers Fitch; Peter J. Dehlinger

(57) ABSTRACT

A recombinant herpesvirus, a method for producing the recombinant herpesvirus, and a pharmaceutical composition comprising the recombinant herpesvirus, are provided with a method for producing a recombinant herpesvirus using a BAC vector sequence. In addition, a vector comprising a herpesvirus genomic gene and a BAC vector sequence, a cell comprising the vector, and a nucleic acid cassette comprising a fragment, which is capable of homologous recombination with a herpesvirus genome, and a BAC vector sequence, are provided.

2 Claims, 2 Drawing Sheets

Figure 1:
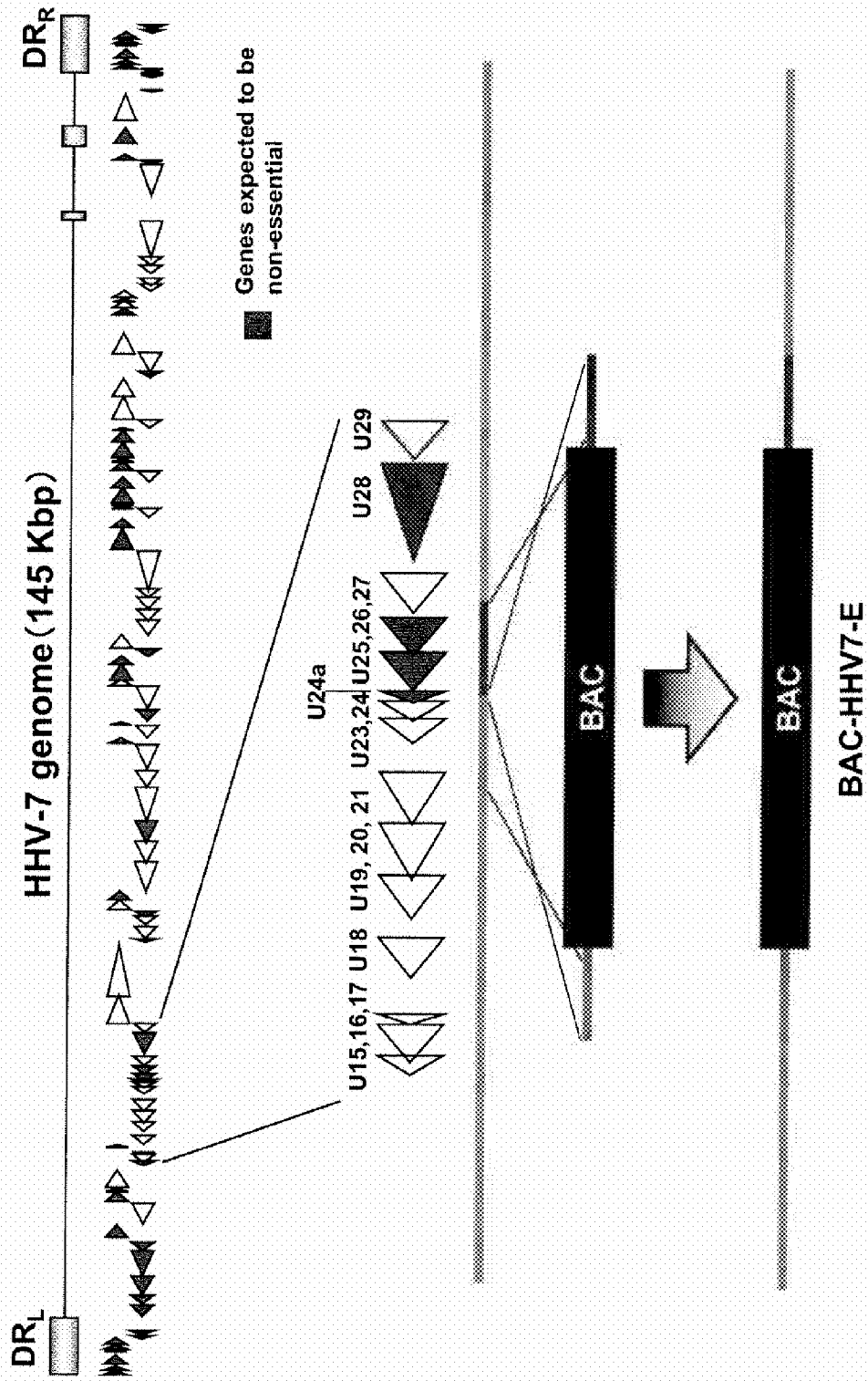

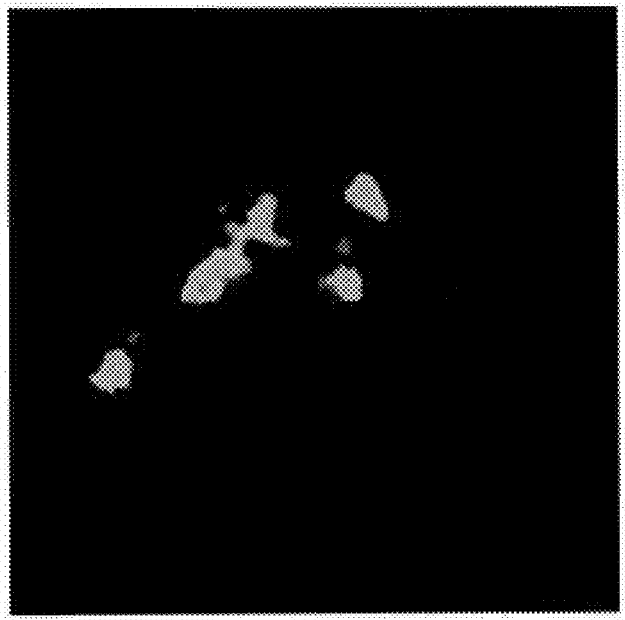
Fig. 2
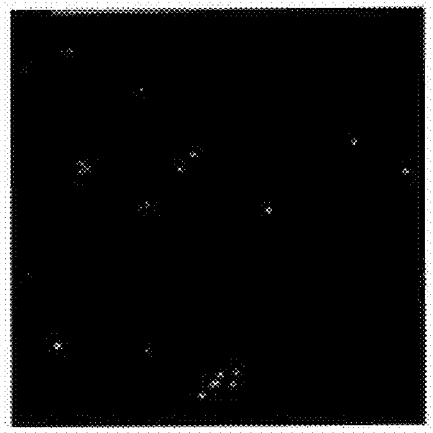
1 times
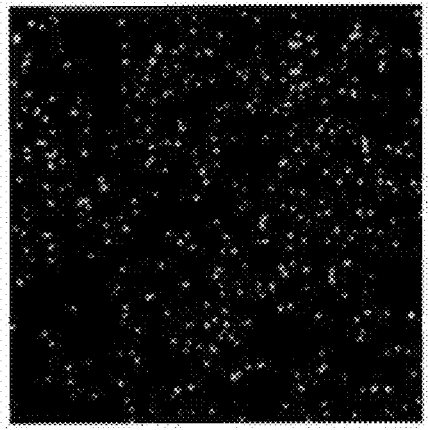
2 times

RECOMBINANT VIRAL VECTOR FOR GENE TRANSFER INTO LYMPHOID CELLS

CROSS REFERENCE TO RELATED APPLICATIONS

This application is a Continuation application of application Ser. No. 10/843,877, filed 12 May 2004, which claims benefit of priority under 35 U.S.C. §119(e) to Japanese Patent Application No. 2004-137953, filed 6 May 2004, the contents of each of which are herein incorporated by reference in their entirety.

REFERENCE TO SEQUENCE LISTING, TABLE OR COMPUTER PROGRAM

A Sequence Listing is being submitted electronically via EFS in the form of a text file, created 7 May 2009, and named "59150-8027.US00 SEQLIST.TXT" (22,644 bytes), the contents of which are incorporated herein by reference in their entirety.

FIELD OF THE INVENTION

The present invention relates to a recombinant viral vector for introducing a desired gene into lymphoid cells, particularly a recombinant human herpes viral vector prepared using BAC (*E. coli* artificial chromosome), and a pharmaceutical composition comprising such a viral vector. Further, the present invention relates to a vector comprising a human herpes viral genomic gene and a BAC vector sequence, and a cell containing such a vector. Further, the present invention relates to a method for producing a recombinant human herpesvirus. Further, the present invention relates to a nucleic acid cassette comprising a fragment capable of homologous recombination with a herpesvirus genome, and a BAC vector sequence.

DESCRIPTION OF THE RELATED ART

There has been a demand for the establishment of a technique for gene therapy with lymphoid cells in order to treat various diseases involving lymphoid cells, e.g., human immunodeficiency virus (HIV) infection. However, no satisfactory vector system for introducing a desired gene into lymphoid cells has been developed.

Herpesvirus (HHV) is a generic term referring to viruses of the family Herpesviridae. Both human herpesvirus 6 and 7 (HHV-6 and HHV-7) are double-stranded DNA viruses of the subfamily β Herpesviridae of the family Herpesviridae, which are responsible for exanthem subitum. (Yamanishi K. et al., "Identification of human herpesvirus 6 as a causal agent for exanthem subitum", Lancet 1988; i: 1065-1067 and Tanaka K. et al., "Human herpesvirus 7: Another causal agent for roseola (exanthem subitum)", J. Pediatr., 1994; 125: 1-5). HHV-6 includes two strains, HHV-6A and HHV-6B. HHV-6 causes a viral infectious disease which often occurs during infancy and induces sudden high fever and exanthema before and after the reduction of fever. The prognosis of infected patients is generally good. HHV-7 infection tends to occur later than HHV-6 infection (Tanaka K. et al., "Seroepidemiological study of human herpesvirus-6 and -7 in children of different ages and detection of these two viruses in throat swabs by polymerase chain reaction", Journal of Medical Virology, 1996; 48: 88-94). Therefore, exanthem subitum caused by HHV-7 is clinically experienced as secondary exanthem subitum. A seroepidemiological study of HHV-6 and HHV-7 demonstrated that most children become positive for antibodies to HHV-6 and HHV-7 before the age of two or three. It has been reported that the inapparent infection rate is 20 to 40%.

HHV-7 is a herpesvirus which was newly found by Frankel et al. in 1990 when a cytopathic effect was observed during culturing of $CD4^+$ T lymphoid cells of a healthy person's peripheral blood (Frankel N. et al., "Isolation of a new herpesvirus from human $CD4^+$ T cells", ProNAS USA, 87: 749-752, ProNAS USA, 87: 749-752, 1990). The virus was isolated from mononuclear cells of human peripheral blood. Both HHV-6 and -7 are $CD4^+$ T lymphoid cell tropic viruses. HHV-7 infects T cells via a receptor CD4 on the cell surface. HHV-7 can grow only in human T lymphoid cells. Therefore, HHV-7 is a virus which can be used for gene modification of human T lymphoid cells.

The HHV-7 genome is double-stranded DNA of about 145 kbp. The whole base sequence has been determined by Nicholas et al. It is known that at least 101 genes are present on the genome (John N. et al., Journal of Virology, Sep. 1996, 5975 to 5989).

However, it is not currently possible to introduce a gene into T lymphoid cells using HHV-7. This is because no technique for preparing a herpesvirus capable of infecting only T lymphoid cells, i.e., recombinant HHV-7 virus, has been developed, and no technique for efficiently introducing a vector into T lymphoid cells has been established. Therefore, there is a demand for a technique for introducing a desired gene into T lymphoid cells using HHV-7 or HHV-6 recombinant virus.

In addition, it is believed that these viruses, particularly HHV-7 virus, have no adverse effect on healthy individuals. If a gene containing an antigenic determinant of various viruses (e.g., mumps) is incorporated into the viral genome of HHV-7 and is expressed by infected cells, HHV-7 is considered to be useful as a vaccine. However, when HHV-7 is used as a vaccine, in terms of quality control and quality assurance, it is preferable that the genotype of the virus is not changed as the virus is subcultured. Therefore, when the recombinant virus is used as a vaccine, it is necessary to stably supply a virus derived from a single recombinant genotype virus. For this purpose, a technique for producing a HHV-7 recombinant virus having a single genotype has been desired.

In addition, the mutual relationship between the HIV infection of a T lymphoid cell strain SupT1 cell and a T lymphoid cell tropic human herpesvirus (HHV-6A (U1102 strain), HHV-7 (MRK, MSO strains)) has been studied. The HHV-7 strain, which binds a receptor CD4 of cells, exhibits satisfactory growth in SupT1 cells. However, infection could not been established for SupT1/HIV cells. In contrast, it has been recognized that HHV-6A strain infects SupT1 cells with HIV-persistent infection (SupT1/HIV) and exhibits clear CPE (Masao Yamada et al., "HIV Jizokukansen SupT1 Saibo heno HHV-6 oyobi-7 Choufukukannsen no Kokoromi (Attempt for HHV-6 and -7 Superinfection to HIV Persistent Infection Sup-T1 Cell)", Title No. 122, Titles and Abstracts of the 7th Annual Meeting of the Japanese Society for AIDS Research, 1993, Tokyo).

An object of the present invention is to provide a recombinant viral vector for introducing a desired gene into lymphoid cells, particularly a recombinant human herpes viral vector prepared using a BAC (*E. coli* artificial chromosome), and a pharmaceutical composition comprising such a viral vector. Another object of the present invention is to provide a vector comprising a human herpes viral genomic gene and a BAC vector sequence, and a cell containing such a vector. Still another object of the present invention is to provide a method for producing a recombinant human herpesvirus. Even still another object of the present invention is to provide a nucleic acid cassette comprising a fragment capable of homologous recombination with a herpesvirus genome, and a BAC vector sequence.

To achieve this, the present invention provides recombinant HHV-7, and a production method thereof, e.g., a method for producing recombinant HHV-7 or HHV-6 from a single virus strain using a BAC (*E. coli* artificial chromosome).

An ideal HIV vaccine can provide complete and long-lasting protection for all types of HIV. On the other hand, conventional inactivated HIV vaccines have advantages and disadvantages, some of which will be described below.

A method for producing a recombinant vaccine employs common techniques. However, since it is difficult to maintain immunogenicity (since immunogenicity is low), high antigenic load and frequent inoculation of an adjuvant are required. Safety is of the greatest concern. A subunit vaccine containing either a native or recombinant subunit may be safe. However, such a subunit vaccine is limited because of the selection of a subunit and the low immunogenicity.

The present invention can realize an effect which cannot be obtained by conventional vaccines. This effect is a function of prevention and treatment before and after HIV infection. This is achieved by the recombinant herpesvirus itself utilizing the same mechanism that HIV uses to bind to its target immune cell (CD4$^+$ T cell).

Conventionally, it is difficult to produce a vaccine for HIV. The reason will be described below. HIV is integrated with the infected cell. In addition, HIV attacks immune cells themselves which are usually activated by a vaccine. When HIV infects a cell, gp120 binds to CD4. CD4 is a receptor present on the surface of an immune cell (T cell) which HIV infects. CD4 can be said to be an entrance to the cell. The growth of HIV can be suppressed by HHV-7 binding to the $CD4^+$ cell surface or HHV-6 entering the cell.

By utilizing the above-described principle, the present invention provides a pharmaceutical composition for the prevention of HIV infection, and a pharmaceutical composition for the treatment of HIV infection.

SUMMARY OF THE INVENTION

The present inventors developed a method for producing a recombinant herpesvirus using a BAC vector sequence to complete the present invention Therefore, the present invention provides the following.

1. A recombinant herpesvirus for gene transfer into lymphoid cells.

2. The recombinant herpesvirus of item 1, comprising BAC vector sequence.

3. The recombinant herpesvirus of item 2, wherein at least part of the BAC vector sequence is inserted into a non-essential region of a herpesvirus genome.

4. The recombinant herpesvirus of item 3, wherein the non-essential region is selected from the group consisting of the following regions of HHV-7:

the region in the ORF of gene H1, the region in the ORF of gene DR1, the region in the ORF of gene DR2, the region in the ORF of gene H2, the region in the ORF of gene DR6, the region in the ORF of gene DR7, the region in the ORF of gene H3, the region in the ORF of gene H4, the region in the ORF of gene U2, the region in the ORF of gene U3, the region in the ORF of gene U4, the region in the ORF of gene U5/7, the region in the ORF of gene U8, the region in the ORF of gene U10, the region in the ORF of gene U12, the region in the ORF of gene U13, the region in the ORF of gene U15, the region in the ORF of gene U16, the region in the ORF of gene U17Ex, the region in the ORF of gene U17, the region in the ORF of gene U17a, the region in the ORF of gene U18, the region in the ORF of gene U19, the region in the ORF of gene U20, the region in the ORF of gene U21, the region in the ORF of gene U23, the region in the ORF of gene U24, the region in the ORF of gene U24a, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55A, the region in the ORF of gene U55B, the region in the ORF of gene U58, the region in the ORF of gene U59, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene H5, the region in the ORF of gene U79, the region in the ORF of gene H6, the region in the ORF of gene U80, the region in the ORF of gene U81, the region in the ORF of gene U84, the region in the ORF of gene U85, the region in the ORF of gene U91, the region in the ORF of gene H7, the region in the ORF of gene U95, the region in the ORF of gene H8, the region flanking the ORF of gene H1, the region flanking the ORF of gene DR1, the region flanking the ORF of gene DR2, the region flanking the ORF of gene H2, the region flanking the ORF of gene DR6, the region flanking the ORF of gene DR7, the region flanking the ORF of gene H3, the region flanking the ORF of gene H4, the region flanking the ORF of gene U2, the region flanking the ORF of gene U3, the region flanking the ORF of gene U4, the region flanking the ORF of gene U5/7, the region flanking the ORF of gene U8, the region flanking the ORF of gene U10, the region flanking the ORF of gene U12, the region flanking the ORF of gene U13, the region flanking the ORF of gene U15, the region flanking the ORF of gene U16, the region flanking the ORF of gene U17Ex, the region flanking the ORF of gene U17, the region flanking the ORF of gene U17a, the region flanking the ORF of gene U18, the region flanking the ORF of gene U19, the region flanking the ORF of gene U20, the region flanking the ORF of gene U21, the region flanking the ORF of gene U23, the region flanking the ORF of gene U24, the region flanking the ORF of gene U24a, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55A, the region flanking the ORF of gene U55B, the region flanking the ORF of gene U58, the region flanking the ORF of gene U59, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene H5, the region flanking the ORF of gene U79, the region flanking the ORF of gene H6, the region flanking the ORF of gene U80, the region flanking the ORF of gene U81, the region flanking the ORF of gene U84, the region flanking the ORF of gene U85, the region flanking the ORF of gene U91, the region flanking the ORF of gene H7, the region flanking the ORF of gene U95, and the region flanking the ORF of gene H8.

5. The recombinant herpesvirus of item 4, wherein the non-essential region is the region flanking the ORF of gene U24, or the region flanking the ORF of gene U24a.

6. The recombinant herpesvirus of item 3, wherein the non-essential region is selected from the group consisting of the following regions of HHV-6A or HHV-6B:

the region in the ORF of gene LT1, the region in the ORF of gene DR1, the region in the ORF of gene DR2, the region in the ORF of gene DR3, the region in the ORF of gene DR4, the region in the ORF of gene DR5, the region in the ORF of gene DR6, the region in the ORF of gene DRHN1, the region in the ORF of gene DR7, the region in the ORF of gene DRHN2, the region in the ORF of gene DR8, the region in the ORF of gene LJ1, the region in the ORF of gene U1, the region in the ORF of gene U2, the region in the ORF of gene U3, the region in the ORF of gene U4, the region in the ORF of gene U5, the region in the ORF of gene U6, the region in the ORF of gene U7, the region in the ORF of gene U8, the region in the ORF of gene U9, the region in the ORF of gene U10, the region in the ORF of gene U12EX, the region in the ORF of gene U12, the region in the ORF of gene U13, the region in the ORF of gene U15, the region in the ORF of gene U16, the region in the ORF of gene U17, the region in the ORF of gene U18, the region in the ORF of gene U19, the region in the ORF of gene U20, the region in the ORF of gene U21, the region in the ORF of gene U22, the region in the ORF of gene U23, the region in the ORF of gene U24, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55, the region in the ORF of gene U58, the region in the ORF of gene U59, the region in the ORF of gene U61, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene U78, the region in the ORF of gene U79, the region in the ORF of gene U80, the region in the ORF of gene U81, the region in the ORF of gene U83, the region in the ORF of gene U84, the region in the ORF of gene U85, the region in the ORF of gene U88, the region in the ORF of gene U91, the region in the ORF of gene U92, the region in the ORF of gene U93, the region in the ORF of gene HN2, the region in the ORF of gene U94, the region in the ORF of gene U95, the region in the ORF of gene U96, the region flanking the ORF of gene LT1, the region flanking the ORF of gene DR1, the region flanking the ORF of gene DR2, the region flanking the ORF of gene DR3, the region flanking the ORF of gene DR4, the region flanking the ORF of gene DR5, the region flanking the ORF of gene DR6, the region flanking the ORF of gene DRHN1, the region flanking the ORF of gene DR7, the region flanking the ORF of gene DRHN2, the region flanking the ORF of gene DR8, the region flanking the ORF of gene LJ1, the region flanking the ORF of gene U1, the region flanking the ORF of gene U2, the region flanking the ORF of gene U3, the region flanking the ORF of gene U4, the region flanking the ORF of gene U5, the region flanking the ORF of gene U6, the region flanking the ORF of gene U7, the region flanking the ORF of gene U8, the region flanking the ORF of gene U9, the region flanking the ORF of gene U10, the region flanking the ORF of gene U12EX, the region flanking the ORF of gene U12, the region flanking the ORF of gene U13, the region flanking the ORF of gene U15, the region flanking the ORF of gene U16, the region flanking the ORF of gene U17, the region flanking the ORF of gene U18, the region flanking the ORF of gene U19, the region flanking the ORF of gene U20, the region flanking the ORF of gene U21, the region flanking the ORF of gene U22, the region flanking the ORF of gene U23, the region flanking the ORF of gene U24, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55, the region flanking the ORF of gene U58, the region flanking the ORF of gene U59, the region flanking the ORF of gene U61, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene U78, the region flanking the ORF of gene U79, the region flanking the ORF of gene U80, the region flanking the ORF of gene U81, the region flanking the ORF of gene U83, the region flanking the ORF of gene U84, the region flanking the ORF of gene U85, the region flanking the ORF of gene U88, the region flanking the ORF of gene U91, the region flanking the ORF of gene U92, the region flanking the ORF of gene U93, the region flanking the ORF of gene HN2, the region flanking the ORF of gene U94, the region flanking the ORF of gene U95, and the region flanking the ORF of gene U96.

7. The recombinant herpesvirus of item 6, wherein the non-essential region is the region flanking the ORF of gene U5 of HHV-6, or the region flanking the ORF of gene U8 of HHV-6.

8. The recombinant herpesvirus of item 3, wherein the BAC vector sequence comprises a recombinant protein dependent recombinant sequence.

9. The recombinant herpesvirus of item 3, wherein the BAC vector sequence comprises a selectable marker.

10. The recombinant herpesvirus of item 9, wherein the selectable marker is drug selectable marker.

11. The recombinant herpesvirus of item 9, wherein the selectable marker is a gene encoding green fluorescent protein.

12. The recombinant herpesvirus of item 3, wherein the herpesvirus genome is derived from a wild type strain.

13. The recombinant herpesvirus of item 3, wherein the herpesvirus genome is derived from a mutant type strain.

14. The recombinant herpesvirus of item 3, wherein the herpesvirus genome is derived from HHV-7 KHR strain.

15. The recombinant herpesvirus of item 3, wherein the herpesvirus genome is derived from HHV-6A U1102 strain or HHV-6B HST strain.

16. The recombinant herpesvirus of item 3, wherein the BAC vector sequence comprises the sequence set forth in SEQ ID NO.: 401.

17. A pharmaceutical composition comprising the virus of item 1.

18. The pharmaceutical composition of item 17, wherein the composition is in the form of vaccine.

19. A vector comprising a human herpesvirus essential gene and a BAC vector sequence.

20. The vector of item 19, wherein a mammalian cell produces a recombinant herpesvirus when the vector is introduced into the mammalian cell.

21. The vector of item 20, wherein a portion where a sequence derived from the herpesvirus genome is linked to the BAC vector sequence is within a non-essential region of the herpesvirus genome.

22. The vector of item 21, wherein the non-essential region is selected from the group consisting of the following regions of HHV-7:

the region in the ORF of gene H1, the region in the ORF of gene DR1, the region in the ORF of gene DR2, the region in the ORF of gene H2, the region in the ORF of gene DR6, the region in the ORF of gene DR7, the region in the ORF of gene H3, the region in the ORF of gene H4, the region in the ORF of gene U2, the region in the ORF of gene U3, the region in the ORF of gene U4, the region in the ORF of gene U5/7, the region in the ORF of gene U8, the region in the ORF of gene U10, the region in the ORF of gene U12, the region in the ORF of gene U13, the region in the ORF of gene U15, the region in the ORF of gene U16, the region in the ORF of gene U17Ex, the region in the ORF of gene U17, the region in the ORF of gene U17a, the region in the ORF of gene U18, the region in the ORF of gene U19, the region in the ORF of gene U20, the region in the ORF of gene U21, the region in the ORF of gene U23, the region in the ORF of gene U24, the region in the ORF of gene U24a, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55A, the region in the ORF of gene U55B, the region in the ORF of gene U58, the region in the ORF of gene U59, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene H5, the region in the ORF of gene U79, the region in the ORF of gene H6, the region in the ORF of gene U80, the region in the ORF of gene U81, the region in the ORF of gene U84, the region in the ORF of gene U85, the region in the ORF of gene U91, the region in the ORF of gene H7, the region in the ORF of gene U95, the region in the ORF of gene H8, the region flanking the ORF of gene H1, the region flanking the ORF of gene DR1, the region flanking the ORF of gene DR2, the region flanking the ORF of gene H2, the region flanking the ORF of gene DR6, the region flanking the ORF of gene DR7, the region flanking the ORF of gene H3, the region flanking the ORF of gene H4, the region flanking the ORF of gene U2, the region flanking the ORF of gene U3, the region flanking the ORF of gene U4, the region flanking the ORF of gene U5/7, the region flanking the ORF of gene U8, the region flanking the ORF of gene U10, the region flanking the ORF of gene U12, the region flanking the ORF of gene U13, the region flanking the ORF of gene U15, the region flanking the ORF of gene U16, the region flanking the ORF of gene U17Ex, the region flanking the ORF of gene U17, the region flanking the ORF of gene U17a, the region flanking the ORF of gene U18, the region flanking the ORF of gene U19, the region flanking the ORF of gene U20, the region flanking the ORF of gene U21, the region flanking the ORF of gene U23, the region flanking the ORF of gene U24, the region flanking the ORF of gene U24a, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55A, the region flanking the ORF of gene U55B, the region flanking the ORF of gene U58, the region flanking the ORF of gene U59, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene H5, the region flanking the ORF of gene U79, the region flanking the ORF of gene H6, the region flanking the ORF of gene U80, the region flanking the ORF of gene U81, the region flanking the ORF of gene U84, the region flanking the ORF of gene U85, the region flanking the ORF of gene U91, the region flanking the ORF of gene H7, the region flanking the ORF of gene U95, and the region flanking the ORF of gene H8.

23. The vector of item 22, wherein the non-essential region is the region flanking the ORF of gene U24 of HHV-7, or the region flanking the ORF of gene U24a of HHV-7.

24. The vector of item 21, wherein the non-essential region is selected from the group consisting of the following regions of HHV-6:

the region in the ORF of gene LT1, the region in the ORF of gene DR1, the region in the ORF of gene DR2, the region in the ORF of gene DR3, the region in the ORF of gene DR4, the region in the ORF of gene DR5, the region in the ORF of gene DR6, the region in the ORF of gene DRHN1, the region in the ORF of gene DR7, the region in the ORF of gene DRHN2, the region in the ORF of gene DR8, the region in the ORF of gene LJ1, the region in the ORF of gene U1, the region in the ORF of gene U2, the region in the ORF of gene U3, the region in the ORF of gene U4, the region in the ORF of gene U5, the region in the ORF of gene U6, the region in the ORF of gene U7, the region in the ORF of gene U8, the region in the ORF of gene U9, the region in the ORF of gene U10, the region in the ORF of gene U12EX, the region in the ORF of gene U12, the region in the ORF of gene U13, the region in the ORF of gene U15, the region in the ORF of gene U16, the region in the ORF of gene U17, the region in the ORF of gene U18, the region in the ORF of gene U19, the region in the ORF of gene U20, the region in the ORF of gene U21, the region in the ORF of gene U22, the region in the ORF of gene U23, the region in the ORF of gene U24, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55, the region in the ORF of gene U58, the region in the ORF of gene U59, the region in the ORF of gene U61, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene U78, the region in the ORF of gene U79, the region in the ORF of gene U80, the region in the ORF of gene U81, the region in the ORF of gene U83, the region in the ORF of gene U84, the region in the ORF of gene U85, the region in the ORF of gene U88, the region in the ORF of gene U91, the region in the ORF of gene U92, the region in the ORF of gene U93, the region in the ORF of gene HN2, the region in the ORF of gene U94, the region in the ORF of gene U95, the region in the ORF of gene U96, the region flanking the ORF of gene LT1, the region flanking the ORF of gene DR1, the region flanking the ORF of gene DR2, the region flanking the ORF of gene DR3, the region flanking the ORF of gene DR4, the region flanking the ORF of gene DR5, the region flanking the ORF of gene DR6, the region flanking the ORF of gene DRHN1, the region flanking the ORF of gene DR7, the region flanking the ORF of gene DRHN2, the region flanking the ORF of gene DR8, the region flanking the ORF of gene LJ1, the region flanking the ORF of gene U1, the region flanking the ORF of gene U2, the region flanking the ORF of gene U3, the region flanking the ORF of gene U4, the region flanking the ORF of gene U5, the region flanking the ORF of gene U6, the region flanking the ORF of gene U7, the region flanking the ORF of gene U8, the region flanking the ORF of gene U9, the region flanking the ORF of gene U10, the region flanking the ORF of gene U12EX, the region flanking the ORF of gene U12, the region flanking the ORF of gene U13, the region flanking the ORF of gene U15, the region flanking the ORF of gene U16, the region flanking the ORF of gene U17, the region flanking the ORF of gene U18, the region flanking the ORF of gene U19, the region flanking the ORF of gene U20, the region flanking the ORF of gene U21, the region flanking the ORF of gene U22, the region flanking the ORF of gene U23, the region flanking the ORF of gene U24, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55, the region flanking the ORF of gene U58, the region flanking the ORF of gene U59, the region flanking the ORF of gene U61, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene U78, the region flanking the ORF of gene U79, the region flanking the ORF of gene U80, the region flanking the ORF of gene U81, the region flanking the ORF of gene U83, the region flanking the ORF of gene U84, the region flanking the ORF of gene U85, the region flanking the ORF of gene U88, the region flanking the ORF of gene U91, the region flanking the ORF of gene U92, the region flanking the ORF of gene U93, the region flanking the ORF of gene HN2, the region flanking the ORF of gene U94, the region flanking the ORF of gene U95, and the region flanking the ORF of gene U96.

25. The vector of item 24, wherein the non-essential region is the region flanking the ORF of gene U5 of HHV-6, or the region flanking the ORF of gene U8 of HHV-6.

26. The vector of item 19, wherein the BAC vector sequence comprises a recombinant protein dependent recombinant sequence.

27. The vector of item 21, wherein the BAC vector sequence comprises a selectable marker.

28. The vector of item 27, wherein the selectable marker is a drug selectable marker.

29. The vector of item 27, wherein the selectable marker is a gene encoding green fluorescent protein.

30. The vector of item 21, wherein the herpesvirus genome is derived from a wild type strain.

31. The vector of item 21, wherein the herpesvirus genome is derived from a mutant type strain.

32. The vector of item 21, wherein the herpesvirus genome is derived from HHV-7 KHR strain.

33. The vector of item 21, wherein the herpesvirus genome is derived from HHV-6A U1102 strain or HHV-6B HST strain.

34. The vector of item 21, wherein the BAC vector sequence comprises the sequence set forth in SEQ ID NO.: 401.

35. A cell comprising the vector of item 21.

36. The cell of item 35, wherein the cell is a bacterial cell.

37. The bacterial cell of item 36, wherein the bacterial cell is *E. coli*.

38. The cell of item 35, wherein the cell is a mammalian cell.

39. The mammalian cell of item 38, wherein the mammalian cell is derived from human.

40. A virus produced by the mammalian cell of item 38.

41. A pharmaceutical composition comprising the virus of item 40.

42. The pharmaceutical composition of item 41, wherein the composition is in the form of vaccine.

43. A method to produce a recombinant herpesvirus, comprising:
introducing a vector comprising a herpesvirus genome essential gene and BAC vector sequence into a mammalian host cell; and
culturing the mammalian host cell to produce a recombinant herpesvirus.

44. The method of item 43, wherein the mammalian host cell is derived from human.

45. The method of item 43, wherein the BAC vector sequence comprises at least two recombinant protein dependent recombinant sequences.

46. The method of item 45, further comprising a step of recombination between the two recombinant protein dependent recombinant sequences.

47. The method of item 43, wherein a portion where a sequence derived from the herpesvirus genome is linked to the BAC vector sequence is within a non-essential region of the herpesvirus genome.

48. The method of item 47, wherein the non-essential region is selected from the group consisting of the following regions of HHV-7:

the region in the ORF of gene H1, the region in the ORF of gene DR1, the region in the ORF of gene DR2, the region in the ORF of gene H2, the region in the ORF of gene DR6, the region in the ORF of gene DR7, the region in the ORF of gene H3, the region in the ORF of gene H4, the region in the ORF of gene U2, the region in the ORF of gene U3, the region in the ORF of gene U4, the region in the ORF of gene U5/7, the region in the ORF of gene U8, the region in the ORF of gene U10, the region in the ORF of gene U12, the region in the ORF of gene U13, the region in the ORF of gene U15, the region in the ORF of gene U16, the region in the ORF of gene U17Ex, the region in the ORF of gene U17, the region in the ORF of gene U17a, the region in the ORF of gene U18, the region in the ORF of gene U19, the region in the ORF of gene U20, the region in the ORF of gene U21, the region in the ORF of gene U23, the region in the ORF of gene U24, the region in the ORF of gene U24a, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55A, the region in the ORF of gene U55B, the region in the ORF of gene U58, the region in the ORF of gene U59, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene H5, the region in the ORF of gene U79, the region in the ORF of gene H6, the region in the ORF of gene U80, the region in the ORF of gene U81, the region in the ORF of gene U84, the region in the ORF of gene U85, the region in the ORF of gene U91, the region in the ORF of gene H7, the region in the ORF of gene U95, the region in the ORF of gene H8, the region flanking the ORF of gene H1, the region flanking the ORF of gene DR1, the region flanking the ORF of gene DR2, the region flanking the ORF of gene H2, the region flanking the ORF of gene DR6, the region flanking the ORF of gene DR7, the region flanking the ORF of gene H3, the region flanking the ORF of gene H4, the region flanking the ORF of gene U2, the region flanking the ORF of gene U3, the region flanking the ORF of gene U4, the region flanking the ORF of gene U5/7, the region flanking the ORF of gene U8, the region flanking the ORF of gene U10, the region flanking the ORF of gene U12, the region flanking the ORF of gene U13, the region flanking the ORF of gene U15, the region flanking the ORF of gene U16, the region flanking the ORF of gene U17Ex, the region flanking the ORF of gene U17, the region flanking the ORF of gene U17a, the region flanking the ORF of gene U18, the region flanking the ORF of gene U19, the region flanking the ORF of gene U20, the region flanking the ORF of gene U21, the region flanking the ORF of gene U23, the region flanking the ORF of gene U24, the region flanking the ORF of gene U24a, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55A, the region flanking the ORF of gene U55B, the region flanking the ORF of gene U58, the region flanking the ORF of gene U59, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene H5, the region flanking the ORF of gene U79, the region flanking the ORF of gene H6, the region flanking the ORF of gene U80, the region flanking the ORF of gene U81, the region flanking the ORF of gene U84, the region flanking the ORF of gene U85, the region flanking the ORF of gene U91, the region flanking the ORF of gene H7, the region flanking the ORF of gene U95, and the region flanking the ORF of gene H8.

49. The method of item 48, wherein the non-essential region is the region flanking the ORF of gene U24 of HHV-7, or the region flanking the ORF of gene U24a of HHV-7.

50. The method of item 47, wherein the non-essential region is selected from the group consisting of the following regions of HHV-6:

the region in the ORF of gene LT1, the region in the ORF of gene DR1, the region in the ORF of gene DR2, the region in the ORF of gene DR3, the region in the ORF of gene DR4, the region in the ORF of gene DR5, the region in the ORF of gene DR6, the region in the ORF of gene DRHN1, the region in the ORF of gene DR7, the region in the ORF of gene DRHN2, the region in the ORF of gene DR8, the region in the ORF of gene LJ1, the region in the ORF of gene U1, the region in the ORF of gene U2, the region in the ORF of gene U3, the region in the ORF of gene U4, the region in the ORF of gene U5, the region in the ORF of gene U6, the region in the ORF of gene U7, the region in the ORF of gene U8, the region in the ORF of gene U9, the region in the ORF of gene U10, the region in the ORF of gene U12EX, the region in the ORF of gene U12, the region in the ORF of gene U13, the region in the ORF of gene U15, the region in the ORF of gene U16, the region in the ORF of gene U17, the region in the ORF of gene U18, the region in the ORF of gene U19, the region in the ORF of gene U20, the region in the ORF of gene U21, the region in the ORF of gene U22, the region in the ORF of gene U23, the region in the ORF of gene U24, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55, the region in the ORF of gene U58, the region in the ORF of gene U59, the region in the ORF of gene U61, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene U78, the region in the ORF of gene U79, the region in the ORF of gene U80, the region in the ORF of gene U81, the region in the ORF of gene U83, the region in the ORF of gene U84, the region in the ORF of gene U85, the region in the ORF of gene U88, the region in the ORF of gene U91, the region in the ORF of gene U92, the region in the ORF of gene U93, the region in the ORF of gene HN2, the region in the ORF of gene U94, the region in the ORF of gene U95, the region in the ORF of gene U96, the region flanking the ORF of gene LT1, the region flanking the ORF of gene DR1, the region flanking the ORF of gene DR2, the region flanking the ORF of gene DR3, the region flanking the ORF of gene DR4, the region flanking the ORF of gene DR5, the region flanking the ORF of gene DR6, the region flanking the ORF of gene DRHN1, the region flanking the ORF of gene DR7, the region flanking the ORF of gene DRHN2, the region flanking the ORF of gene DR8, the region flanking the ORF of gene LJ1, the region flanking the ORF of gene U1, the region flanking the ORF of gene U2, the region flanking the ORF of gene U3, the region flanking the ORF of gene U4, the region flanking the ORF of gene U5, the region flanking the ORF of gene U6, the region flanking the ORF of gene U7, the region flanking the ORF of gene U8, the region flanking the ORF of gene U9, the region flanking the ORF of gene U10, the region flanking the ORF of gene U12EX, the region flanking the ORF of gene U12, the region flanking the ORF of gene U13, the region flanking the ORF of gene U15, the region flanking the ORF of gene U16, the region flanking the ORF of gene U17, the region flanking the ORF of gene U18, the region flanking the ORF of gene U19, the region flanking the ORF of gene U20, the region flanking the ORF of gene U21, the region flanking the ORF of gene U22, the region flanking the ORF of gene U23, the region flanking the ORF of gene U24, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55, the region flanking the ORF of gene U58, the region flanking the ORF of gene U59, the region flanking the ORF of gene U61, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene U78, the region flanking the ORF of gene U79, the region flanking the ORF of gene U80, the region flanking the ORF of gene U81, the region flanking the ORF of gene U83, the region flanking the ORF of gene U84, the region flanking the ORF of gene U85, the region flanking the ORF of gene U88, the region flanking the ORF of gene U91, the region flanking the ORF of gene U92, the region flanking the ORF of gene U93, the region flanking the ORF of gene HN2, the region flanking the ORF of gene U94, the region flanking the ORF of gene U95, and the region flanking the ORF of gene U96.

51. The method of item 50, wherein the non-essential region is the region flanking the ORF of gene U5 of HHV-6, or the region flanking the ORF of gene U8 of HHV-6.

52. The method of item 43, wherein the BAC vector sequence comprises a recombinant protein dependent recombinant sequence.

53. The method of item 43, wherein the BAC vector sequence comprises a selectable marker.

54. The method of item 53, wherein the selectable marker is a drug selectable marker.

55. The method of item 53, wherein the selectable marker is a gene encoding green fluorescent protein.

56. The method of item 43, wherein the herpesvirus genome is derived from a wild type strain.

57. The method of item 43, wherein the herpesvirus genome is derived from a mutant type strain.

58. The method of item 43, wherein the herpesvirus genome is derived from HHV-7 KHR strain.

59. The method of item 43, wherein the herpesvirus genome is derived from HHV-6A U1102 strain or HHV-6B HST strain.

60. The method of item 43, wherein the BAC vector sequence comprises the sequence set forth in SEQ ID NO.: 401.

61. A virus produced by the method of item 43.

62. A pharmaceutical composition comprising the virus of item 61.

63. The pharmaceutical composition of item 62, wherein the composition is in the form of vaccine.

64. A method to introduce a mutation into the vector of item 19, comprising:
introducing the vector into a bacterial host cell;
introducing a plasmid vector comprising a fragment consisting of a portion of herpesvirus genome into the bacterial host cell, wherein the fragment has at least one mutation;
culturing the bacterial host cell;
isolating a vector having BAC sequence from the cultured bacterial host cell.

65. A method to introduce a mutation into the vector of item 19, comprising:
introducing the vector into a bacterial host cell;
introducing a first plasmid vector comprising a first fragment consisting of a portion of herpesvirus genome into the bacterial host cell, wherein the first fragment has at least one mutation;
introducing a second plasmid vector comprising a second fragment consisting of a portion of herpesvirus genome into the bacterial host cell, wherein the second fragment has at least one mutation, and the first fragment is different from the second fragment;
culturing the bacterial host cell;
isolating a vector having BAC sequence from the cultured bacterial host cell.

66. A nucleic acid cassette comprising a first fragment which can recombine with herpesvirus genome in a bacterial cell, BAC vector sequence, and a second fragment which can recombine with herpesvirus genome in a bacterial cell,
wherein the both ends of the BAC sequence are linked to the first and the second fragment, respectively.

67. The nucleic acid cassette of item 66, wherein the first fragment and the second fragment are at least 1 kb.

68. The nucleic acid cassette of item 66, wherein the first fragment and the second fragment are at least 1.5 kb.

69. The nucleic acid cassette of item 66, wherein the first fragment and the second fragment are at least 2 kb.

70. The nucleic acid cassette of item 66, wherein the first fragment and the second fragment are at least 80% identical with a herpesvirus genome sequence.

71. The nucleic acid cassette of item 66, wherein the first fragment and the second fragment are at least 85% identical with a herpesvirus genome sequence.

72. The nucleic acid cassette of item 66, wherein the first fragment and the second fragment are at least 90% identical with a herpesvirus genome sequence.

73. The nucleic acid cassette of item 66, wherein the first fragment and the second fragment are at least 95% identical with a herpesvirus genome sequence.

74. The nucleic acid cassette of item 66, wherein each of the first fragment and the second fragment are independently selected from the group consisting of the following regions of herpesvirus HHV-7 genome:
the region in the ORF of gene H1, the region in the ORF of gene DR1, the region in the ORF of gene DR2, the region in the ORF of gene H2, the region in the ORF of gene DR6, the region in the ORF of gene DR7, the region in the ORF of gene H3, the region in the ORF of gene H4, the region in the ORF of gene U2, the region in the ORF of gene U3, the region in the ORF of gene U4, the region in the ORF of gene U5/7, the region in the ORF of gene U8, the region in the ORF of gene U10, the region in the ORF of gene U12, the region in the ORF of gene U13, the region in the ORF of gene U15, the region in the ORF of gene U16, the region in the ORF of gene U17Ex, the region in the ORF of gene U17, the region in the ORF of gene U17a, the region in the ORF of gene U18, the region in the ORF of gene U19, the region in the ORF of gene U20, the region in the ORF of gene U21, the region in the ORF of gene U23, the region in the ORF of gene U24, the region in the ORF of gene U24a, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55A, the region in the ORF of gene U55B, the region in the ORF of gene U58, the region in the ORF of gene U59, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene H5, the region in the ORF of gene U79, the region in the ORF of gene H6, the region in the ORF of gene U80, the region in the ORF of gene U81, the region in the ORF of gene U84, the region in the ORF of gene U85, the region in the ORF of gene U91, the region in the ORF of gene H7, the region in the ORF of gene U95, the region in the ORF of gene H8, the region flanking the ORF of gene H1, the region flanking the ORF of gene DR1, the region flanking the ORF of gene DR2, the region flanking the ORF of gene H2, the region flanking the ORF of gene DR6, the region flanking the ORF of gene DR7, the region flanking the ORF of gene H3, the region flanking the ORF of gene H4, the region flanking the ORF of gene U2, the region flanking the ORF of gene U3, the region flanking the ORF of gene U4, the region flanking the ORF of gene U5/7, the region flanking the ORF of gene U8, the region flanking the ORF of gene U10, the region flanking the ORF of gene U12, the region flanking the ORF of gene U13, the region flanking the ORF of gene U15, the region flanking the ORF of gene U16, the region flanking the ORF of gene U17Ex, the region flanking the ORF of gene U17, the region flanking the ORF of gene U17a, the region flanking the ORF of gene U18, the region flanking the ORF of gene U19, the region flanking the ORF of gene U20, the region flanking the ORF of gene U21, the region flanking the ORF of gene U23, the region flanking the ORF of gene U24, the region flanking the ORF of gene U24a, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55A, the region flanking the ORF of gene U55B, the region flanking the ORF of gene U58, the region flanking the ORF of gene U59, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene H5, the region flanking the ORF of gene U79, the region flanking the ORF of gene H6, the region flanking the ORF of gene U80, the region flanking the ORF of gene U81, the region flanking the ORF of gene U84, the region flanking the ORF of gene U85, the region flanking the ORF of gene U91, the region flanking the ORF of gene H7, the region flanking the ORF of gene U95, and the region flanking the ORF of gene H8.

75. The nucleic acid cassette of item 66, wherein each of the first fragment and the second fragment is independently at least 80% identical with the region selected from the group consisting of the following regions of herpesvirus HHV-7 genome:

the region in the ORF of gene H1, the region in the ORF of gene DR1, the region in the ORF of gene DR2, the region in the ORF of gene H2, the region in the ORF of gene DR6, the region in the ORF of gene DR7, the region in the ORF of gene H3, the region in the ORF of gene H4, the region in the ORF of gene U2, the region in the ORF of gene U3, the region in the ORF of gene U4, the region in the ORF of gene U5/7, the region in the ORF of gene U8, the region in the ORF of gene U10, the region in the ORF of gene U12, the region in the ORF of gene U13, the region in the ORF of gene U15, the region in the ORF of gene U16, the region in the ORF of gene U17Ex, the region in the ORF of gene U17, the region in the ORF of gene U17a, the region in the ORF of gene U18, the region in the ORF of gene U19, the region in the ORF of gene U20, the region in the ORF of gene U21, the region in the ORF of gene U23, the region in the ORF of gene U24, the region in the ORF of gene U24a, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55A, the region in the ORF of gene U55B, the region in the ORF of gene U58, the region in the ORF of gene U59, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene H5, the region in the ORF of gene U79, the region in the ORF of gene H6, the region in the ORF of gene U80, the region in the ORF of gene U81, the region in the ORF of gene U84, the region in the ORF of gene U85, the region in the ORF of gene U91, the region in the ORF of gene H7, the region in the ORF of gene U95, the region in the ORF of gene H8, the region flanking the ORF of gene H1, the region flanking the ORF of gene DR1, the region flanking the ORF of gene DR2, the region flanking the ORF of gene H2, the region flanking the ORF of gene DR6, the region flanking the ORF of gene DR7, the region flanking the ORF of gene H3, the region flanking the ORF of gene H4, the region flanking the ORF of gene U2, the region flanking the ORF of gene U3, the region flanking the ORF of gene U4, the region flanking the ORF of gene U5/7, the region flanking the ORF of gene U8, the region flanking the ORF of gene U10, the region flanking the ORF of gene U12, the region flanking the ORF of gene U13, the region flanking the ORF of gene U15, the region flanking the ORF of gene U16, the region flanking the ORF of gene U17Ex, the region flanking the ORF of gene U17, the region flanking the ORF of gene U17a, the region flanking the ORF of gene U18, the region flanking the ORF of gene U19, the region flanking the ORF of gene U20, the region flanking the ORF of gene U21, the region flanking the ORF of gene U23, the region flanking the ORF of gene U24, the region flanking the ORF of gene U24a, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55A, the region flanking the ORF of gene U55B, the region flanking the ORF of gene U58, the region flanking the ORF of gene U59, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene H5, the region flanking the ORF of gene U79, the region flanking the ORF of gene H6, the region flanking the ORF of gene U80, the region flanking the ORF of gene U81, the region flanking the ORF of gene U84, the region flanking the ORF of gene U85, the region flanking the ORF of gene U91, the region flanking the ORF of gene H7, the region flanking the ORF of gene U95, and the region flanking the ORF of gene H8.

76. The nucleic acid cassette of item 66, wherein each of the first fragment and the second fragment is independently at least 85% identical with the region selected from the group consisting of the following regions of herpesvirus HHV-7 genome:

the region in the ORF of gene H1, the region in the ORF of gene DR1, the region in the ORF of gene DR2, the region in the ORF of gene H2, the region in the ORF of gene DR6, the region in the ORF of gene DR7, the region in the ORF of gene H3, the region in the ORF of gene H4, the region in the ORF of gene U2, the region in the ORF of gene U3, the region in the ORF of gene U4, the region in the ORF of gene U5/7, the region in the ORF of gene U8, the region in the ORF of gene U10, the region in the ORF of gene U12, the region in the ORF of gene U13, the region in the ORF of gene U15, the region in the ORF of gene U16, the region in the ORF of gene U17Ex, the region in the ORF of gene U17, the region in the ORF of gene U17a, the region in the ORF of gene U18, the region in the ORF of gene U19, the region in the ORF of gene U20, the region in the ORF of gene U21, the region in the ORF of gene U23, the region in the ORF of gene U24, the region in the ORF of gene U24a, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55A, the region in the ORF of gene U55B, the region in the ORF of gene U58, the region in the ORF of gene U59, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene H5, the region in the ORF of gene U79, the region in the ORF of gene H6, the region in the ORF of gene U80, the region in the ORF of gene U81, the region in the ORF of gene U84, the region in the ORF of gene U85, the region in the ORF of gene U91, the region in the ORF of gene H7, the region in the ORF of gene U95, the region in the ORF of gene H8, the region flanking the ORF of gene H1, the region flanking the ORF of gene DR1, the region flanking the ORF of gene DR2, the region flanking the ORF of gene H2, the region flanking the ORF of gene DR6, the region flanking the ORF of gene DR7, the region flanking the ORF of gene H3, the region flanking the ORF of gene H4, the region flanking the ORF of gene U2, the region flanking the ORF of gene U3, the region flanking the ORF of gene U4, the region flanking the ORF of gene U5/7, the region flanking the ORF of gene U8, the region flanking the ORF of gene U10, the region flanking the ORF of gene U12, the region flanking the ORF of gene U13, the region flanking the ORF of gene U15, the region flanking the ORF of gene U16, the region flanking the ORF of gene U17Ex, the region flanking the ORF of gene U17, the region flanking the ORF of gene U17a, the region flanking the ORF of gene U18, the region flanking the ORF of gene U19, the region flanking the ORF of gene U20, the region flanking the ORF of gene U21, the region flanking the ORF of gene U23, the region flanking the ORF of gene U24, the region flanking the ORF of gene U24a, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55A, the region flanking the ORF of gene U55B, the region flanking the ORF of gene U58, the region flanking the ORF of gene U59, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene H5, the region flanking the ORF of gene U79, the region flanking the ORF of gene H6, the region flanking the ORF of gene U80, the region flanking the ORF of gene U81, the region flanking the ORF of gene U84, the region flanking the ORF of gene U85, the region flanking the ORF of gene U91, the region flanking the ORF of gene H7, the region flanking the ORF of gene U95, and the region flanking the ORF of gene H8.

77. The nucleic acid cassette of item 66, wherein each of the first fragment and the second fragment is independently at least 90% identical with the region selected from the group consisting of the following regions of herpesvirus HHV-7 genome:

the region in the ORF of gene H1, the region in the ORF of gene DR1, the region in the ORF of gene DR2, the region in the ORF of gene H2, the region in the ORF of gene DR6, the region in the ORF of gene DR7, the region in the ORF of gene H3, the region in the ORF of gene H4, the region in the ORF of gene U2, the region in the ORF of gene U3, the region in the ORF of gene U4, the region in the ORF of gene U5/7, the region in the ORF of gene U8, the region in the ORF of gene U10, the region in the ORF of gene U12, the region in the ORF of gene U13, the region in the ORF of gene U15, the region in the ORF of gene U16, the region in the ORF of gene U17Ex, the region in the ORF of gene U17, the region in the ORF of gene U17a, the region in the ORF of gene U18, the region in the ORF of gene U19, the region in the ORF of gene U20, the region in the ORF of gene U21, the region in the ORF of gene U23, the region in the ORF of gene U24, the region in the ORF of gene U24a, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55A, the region in the ORF of gene U55B, the region in the ORF of gene U58, the region in the ORF of gene U59, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene H5, the region in the ORF of gene U79, the region in the ORF of gene H6, the region in the ORF of gene U80, the region in the ORF of gene U81, the region in the ORF of gene U84, the region in the ORF of gene U85, the region in the ORF of gene U91, the region in the ORF of gene H7, the region in the ORF of gene U95, the region in the ORF of gene H8, the region flanking the ORF of gene H1, the region flanking the ORF of gene DR1, the region flanking the ORF of gene DR2, the region flanking the ORF of gene H2, the region flanking the ORF of gene DR6, the region flanking the ORF of gene DR7, the region flanking the ORF of gene H3, the region flanking the ORF of gene H4, the region flanking the ORF of gene U2, the region flanking the ORF of gene U3, the region flanking the ORF of gene U4, the region flanking the ORF of gene U5/7, the region flanking the ORF of gene U8, the region flanking the ORF of gene U10, the region flanking the ORF of gene U12, the region flanking the ORF of gene U13, the region flanking the ORF of gene U15, the region flanking the ORF of gene U16, the region flanking the ORF of gene U17Ex, the region flanking the ORF of gene U17, the region flanking the ORF of gene U17a, the region flanking the ORF of gene U18, the region flanking the ORF of gene U19, the region flanking the ORF of gene U20, the region flanking the ORF of gene U21, the region flanking the ORF of gene U23, the region flanking the ORF of gene U24, the region flanking the ORF of gene U24a, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55A, the region flanking the ORF of gene U55B, the region flanking the ORF of gene U58, the region flanking the ORF of gene U59, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene H5, the region flanking the ORF of gene U79, the region flanking the ORF of gene H6, the region flanking the ORF of gene U80, the region flanking the ORF of gene U81, the region flanking the ORF of gene U84, the region flanking the ORF of gene U85, the region flanking the ORF of gene U91, the region flanking the ORF of gene H7, the region flanking the ORF of gene U95, and the region flanking the ORF of gene H8.

78. The nucleic acid cassette of item 66, wherein each of the first fragment and the second fragment is independently at least 95% identical with the region selected from the group consisting of the following regions of herpesvirus HHV-7 genome:

the region in the ORF of gene H1, the region in the ORF of gene DR1, the region in the ORF of gene DR2, the region in the ORF of gene H2, the region in the ORF of gene DR6, the region in the ORF of gene DR7, the region in the ORF of gene H3, the region in the ORF of gene H4, the region in the ORF of gene U2, the region in the ORF of gene U3, the region in the ORF of gene U4, the region in the ORF of gene U5/7, the region in the ORF of gene U8, the region in the ORF of gene U10, the region in the ORF of gene U12, the region in the ORF of gene U13, the region in the ORF of gene U15, the region in the ORF of gene U16, the region in the ORF of gene U17Ex, the region in the ORF of gene U17, the region in the ORF of gene U17a, the region in the ORF of gene U18, the region in the ORF of gene U19, the region in the ORF of gene U20, the region in the ORF of gene U21, the region in the ORF of gene U23, the region in the ORF of gene U24, the region in the ORF of gene U24a, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55A, the region in the ORF of gene U55B, the region in the ORF of gene U58, the region in the ORF of gene U59, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene H5, the region in the ORF of gene U79, the region in the ORF of gene H6, the region in the ORF of gene U80, the region in the ORF of gene U81, the region in the ORF of gene U84, the region in the ORF of gene U85, the region in the ORF of gene U91, the region in the ORF of gene H7, the region in the ORF of gene U95, the region in the ORF of gene H8, the region flanking the ORF of gene H1, the region flanking the ORF of gene DR1, the region flanking the ORF of gene DR2, the region flanking the ORF of gene H2, the region flanking the ORF of gene DR6, the region flanking the ORF of gene DR7, the region flanking the ORF of gene H3, the region flanking the ORF of gene H4, the region flanking the ORF of gene U2, the region flanking the ORF of gene U3, the region flanking the ORF of gene U4, the region flanking the ORF of gene U5/7, the region flanking the ORF of gene U8, the region flanking the ORF of gene U10, the region flanking the ORF of gene U12, the region flanking the ORF of gene U13, the region flanking the ORF of gene U15, the region flanking the ORF of gene U16, the region flanking the ORF of gene U17Ex, the region flanking the ORF of gene U17, the region flanking the ORF of gene U17a, the region flanking the ORF of gene U18, the region flanking the ORF of gene U19, the region flanking the ORF of gene U20, the region flanking the ORF of gene U21, the region flanking the ORF of gene U23, the region flanking the ORF of gene U24, the region flanking the ORF of gene U24a, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55A, the region flanking the ORF of gene U55B, the region flanking the ORF of gene U58, the region flanking the ORF of gene U59, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene H5, the region flanking the ORF of gene U79, the region flanking the ORF of gene H6, the region flanking the ORF of gene U80, the region flanking the ORF of gene U81, the region flanking the ORF of gene U84, the region flanking the ORF of gene U85, the region flanking the ORF of gene U91, the region flanking the ORF of gene H7, the region flanking the ORF of gene U95, and the region flanking the ORF of gene H8.

79. The nucleic acid cassette of item 66, wherein each of the first fragment and the second fragment are independently selected from the group consisting of the following regions of herpesvirus HHV-6 genome:

the region in the ORF of gene LT1, the region in the ORF of gene DR1, the region in the ORF of gene DR2, the region in the ORF of gene DR3, the region in the ORF of gene DR4, the region in the ORF of gene DR5, the region in the ORF of gene DR6, the region in the ORF of gene DRHN1, the region in the ORF of gene DR7, the region in the ORF of gene DRHN2, the region in the ORF of gene DR8, the region in the ORF of gene LJ1, the region in the ORF of gene U1, the region in the ORF of gene U2, the region in the ORF of gene U3, the region in the ORF of gene U4, the region in the ORF of gene U5, the region in the ORF of gene U6, the region in the ORF of gene U7, the region in the ORF of gene U8, the region in the ORF of gene U9, the region in the ORF of gene U10, the region in the ORF of gene U12EX, the region in the ORF of gene U12, the region in the ORF of gene U13, the region in the ORF of gene U15, the region in the ORF of gene U16, the region in the ORF of gene U17, the region in the ORF of gene U18, the region in the ORF of gene U19, the region in the ORF of gene U20, the region in the ORF of gene U21, the region in the ORF of gene U22, the region in the ORF of gene U23, the region in the ORF of gene U24, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55, the region in the ORF of gene U58, the region in the ORF of gene U59, the region in the ORF of gene U61, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene U78, the region in the ORF of gene U79, the region in the ORF of gene U80, the region in the ORF of gene U81, the region in the ORF of gene U83, the region in the ORF of gene U84, the region in the ORF of gene U85, the region in the ORF of gene U88, the region in the ORF of gene U91, the region in the ORF of gene U92, the region in the ORF of gene U93, the region in the ORF of gene HN2, the region in the ORF of gene U94, the region in the ORF of gene U95, the region in the ORF of gene U96, the region flanking the ORF of gene LT1, the region flanking the ORF of gene DR1, the region flanking the ORF of gene DR2, the region flanking the ORF of gene DR3, the region flanking the ORF of gene DR4, the region flanking the ORF of gene DR5, the region flanking the ORF of gene DR6, the region flanking the ORF of gene DRHN1, the region flanking the ORF of gene DR7, the region flanking the ORF of gene DRHN2, the region flanking the ORF of gene DR8, the region flanking the ORF of gene LJ1, the region flanking the ORF of gene U1, the region flanking the ORF of gene U2, the region flanking the ORF of gene U3, the region flanking the ORF of gene U4, the region flanking the ORF of gene U5, the region flanking the ORF of gene U6, the region flanking the ORF of gene U7, the region flanking the ORF of gene U8, the region flanking the ORF of gene U9, the region flanking the ORF of gene U10, the region flanking the ORF of gene U12EX, the region flanking the ORF of gene U12, the region flanking the ORF of gene U13, the region flanking the ORF of gene U15, the region flanking the ORF of gene U16, the region flanking the ORF of gene U17, the region flanking the ORF of gene U18, the region flanking the ORF of gene U19, the region flanking the ORF of gene U20, the region flanking the ORF of gene U21, the region flanking the ORF of gene U22, the region flanking the ORF of gene U23, the region flanking the ORF of gene U24, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55, the region flanking the ORF of gene U58, the region flanking the ORF of gene U59, the region flanking the ORF of gene U61, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene U78, the region flanking the ORF of gene U79, the region flanking the ORF of gene U80, the region flanking the ORF of gene U81, the region flanking the ORF of gene U83, the region flanking the ORF of gene U84, the region flanking the ORF of gene U85, the region flanking the ORF of gene U88, the region flanking the ORF of gene U91, the region flanking the ORF of gene U92, the region flanking the ORF of gene U93, the region flanking the ORF of gene HN2, the region flanking the ORF of gene U94, the region flanking the ORF of gene U95, and the region flanking the ORF of gene U96.

80. The nucleic acid cassette of item 66, wherein each of the first fragment and the second fragment is independently at least 80% identical with the region selected from the group consisting of the following regions of herpesvirus HHV-6 genome:

the region in the ORF of gene LT1, the region in the ORF of gene DR1, the region in the ORF of gene DR2, the region in the ORF of gene DR3, the region in the ORF of gene DR4, the region in the ORF of gene DR5, the region in the ORF of gene DR6, the region in the ORF of gene DRHN1, the region in the ORF of gene DR7, the region in the ORF of gene DRHN2, the region in the ORF of gene DR8, the region in the ORF of gene LJ1, the region in the ORF of gene U1, the region in the ORF of gene U2, the region in the ORF of gene U3, the region in the ORF of gene U4, the region in the ORF of gene U5, the region in the ORF of gene U6, the region in the ORF of gene U7, the region in the ORF of gene U8, the region in the ORF of gene U9, the region in the ORF of gene U10, the region in the ORF of gene U12EX, the region in the ORF of gene U12, the region in the ORF of gene U13, the region in the ORF of gene U15, the region in the ORF of gene U16, the region in the ORF of gene U17, the region in the ORF of gene U18, the region in the ORF of gene U19, the region in the ORF of gene U20, the region in the ORF of gene U21, the region in the ORF of gene U22, the region in the ORF of gene U23, the region in the ORF of gene U24, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55, the region in the ORF of gene U58, the region in the ORF of gene U59, the region in the ORF of gene U61, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene U78, the region in the ORF of gene U79, the region in the ORF of gene U80, the region in the ORF of gene U81, the region in the ORF of gene U83, the region in the ORF of gene U84, the region in the ORF of gene U85, the region in the ORF of gene U88, the region in the ORF of gene U91, the region in the ORF of gene U92, the region in the ORF of gene U93, the region in the ORF of gene HN2, the region in the ORF of gene U94, the region in the ORF of gene U95, the region in the ORF of gene U96, the region flanking the ORF of gene LT1, the region flanking the ORF of gene DR1, the region flanking the ORF of gene DR2, the region flanking the ORF of gene DR3, the region flanking the ORF of gene DR4, the region flanking the ORF of gene DR5, the region flanking the ORF of gene DR6, the region flanking the ORF of gene DRHN1, the region flanking the ORF of gene DR7, the region flanking the ORF of gene DRHN2, the region flanking the ORF of gene DR8, the region flanking the ORF of gene LJ1, the region flanking the ORF of gene U1, the region flanking the ORF of gene U2, the region flanking the ORF of gene U3, the region flanking the ORF of gene U4, the region flanking the ORF of gene U5, the region flanking the ORF of gene U6, the region flanking the ORF of gene U7, the region flanking the ORF of gene U8, the region flanking the ORF of gene U9, the region flanking the ORF of gene U10, the region flanking the ORF of gene U12EX, the region flanking the ORF of gene U12, the region flanking the ORF of gene U13, the region flanking the ORF of gene U15, the region flanking the ORF of gene U16, the region flanking the ORF of gene U17, the region flanking the ORF of gene U18, the region flanking the ORF of gene U19, the region flanking the ORF of gene U20, the region flanking the ORF of gene U21, the region flanking the ORF of gene U22, the region flanking the ORF of gene U23, the region flanking the ORF of gene U24, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55, the region flanking the ORF of gene U58, the region flanking the ORF of gene U59, the region flanking the ORF of gene U61, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene U78, the region flanking the ORF of gene U79, the region flanking the ORF of gene U80, the region flanking the ORF of gene U81, the region flanking the ORF of gene U83, the region flanking the ORF of gene U84, the region flanking the ORF of gene U85, the region flanking the ORF of gene U88, the region flanking the ORF of gene U91, the region flanking the ORF of gene U92, the region flanking the ORF of gene U93, the region flanking the ORF of gene HN2, the region flanking the ORF of gene U94, the region flanking the ORF of gene U95, and the region flanking the ORF of gene U96.

81. The nucleic acid cassette of item 66, wherein each of the first fragment and the second fragment is independently at least 85% identical with the region selected from the group consisting of the following regions of herpesvirus HHV-6 genome:

the region in the ORF of gene LT1, the region in the ORF of gene DR1, the region in the ORF of gene DR2, the region in the ORF of gene DR3, the region in the ORF of gene DR4, the region in the ORF of gene DR5, the region in the ORF of gene DR6, the region in the ORF of gene DRHN1, the region in the ORF of gene DR7, the region in the ORF of gene DRHN2, the region in the ORF of gene DR8, the region in the ORF of gene LJ1, the region in the ORF of gene U1, the region in the ORF of gene U2, the region in the ORF of gene U3, the region in the ORF of gene U4, the region in the ORF of gene U5, the region in the ORF of gene U6, the region in the ORF of gene U7, the region in the ORF of gene U8, the region in the ORF of gene U9, the region in the ORF of gene U10, the region in the ORF of gene U12EX, the region in the ORF of gene U12, the region in the ORF of gene U13, the region in the ORF of gene U15, the region in the ORF of gene U16, the region in the ORF of gene U17, the region in the ORF of gene U18, the region in the ORF of gene U19, the region in the ORF of gene U20, the region in the ORF of gene U21, the region in the ORF of gene U22, the region in the ORF of gene U23, the region in the ORF of gene U24, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55, the region in the ORF of gene U58, the region in the ORF of gene U59, the region in the ORF of gene U61, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene U78, the region in the ORF of gene U79, the region in the ORF of gene U80, the region in the ORF of gene U81, the region in the ORF of gene U83, the region in the ORF of gene U84, the region in the ORF of gene U85, the region in the ORF of gene U88, the region in the ORF of gene U91, the region in the ORF of gene U92, the region in the ORF of gene U93, the region in the ORF of gene HN2, the region in the ORF of gene U94, the region in the ORF of gene U95, the region in the ORF of gene U96, the region flanking the ORF of gene LT1, the region flanking the ORF of gene DR1, the region flanking the ORF of gene DR2, the region flanking the ORF of gene DR3, the region flanking the ORF of gene DR4, the region flanking the ORF of gene DR5, the region flanking the ORF of gene DR6, the region flanking the ORF of gene DRHN1, the region flanking the ORF of gene DR7, the region flanking the ORF of gene DRHN2, the region flanking the ORF of gene DR8, the region flanking the ORF of gene LJ1, the region flanking the ORF of gene U1, the region flanking the ORF of gene U2, the region flanking the ORF of gene U3, the region flanking the ORF of gene U4, the region flanking the ORF of gene U5, the region flanking the ORF of gene U6, the region flanking the ORF of gene U7, the region flanking the ORF of gene U8, the region flanking the ORF of gene U9, the region flanking the ORF of gene U10, the region flanking the ORF of gene U12EX, the region flanking the ORF of gene U12, the region flanking the ORF of gene U13, the region flanking the ORF of gene U15, the region flanking the ORF of gene U16, the region flanking the ORF of gene U17, the region flanking the ORF of gene U18, the region flanking the ORF of gene U19, the region flanking the ORF of gene U20, the region flanking the ORF of gene U21, the region flanking the ORF of gene U22, the region flanking the ORF of gene U23, the region flanking the ORF of gene U24, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55, the region flanking the ORF of gene U58, the region flanking the ORF of gene U59, the region flanking the ORF of gene U61, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene U78, the region flanking the ORF of gene U79, the region flanking the ORF of gene U80, the region flanking the ORF of gene U81, the region flanking the ORF of gene U83, the region flanking the ORF of gene U84, the region flanking the ORF of gene U85, the region flanking the ORF of gene U88, the region flanking the ORF of gene U91, the region flanking the ORF of gene U92, the region flanking the ORF of gene U93, the region flanking the ORF of gene HN2, the region flanking the ORF of gene U94, the region flanking the ORF of gene U95, and the region flanking the ORF of gene U96.

82. The nucleic acid cassette of item 66, wherein each of the first fragment and the second fragment is independently at least 90% identical with the region selected from the group consisting of the following regions of herpesvirus HHV-6 genome:

the region in the ORF of gene LT1, the region in the ORF of gene DR1, the region in the ORF of gene DR2, the region in the ORF of gene DR3, the region in the ORF of gene DR4, the region in the ORF of gene DR5, the region in the ORF of gene DR6, the region in the ORF of gene DRHN1, the region in the ORF of gene DR7, the region in the ORF of gene DRHN2, the region in the ORF of gene DR8, the region in the ORF of gene LJ1, the region in the ORF of gene U1, the region in the ORF of gene U2, the region in the ORF of gene U3, the region in the ORF of gene U4, the region in the ORF of gene U5, the region in the ORF of gene U6, the region in the ORF of gene U7, the region in the ORF of gene U8, the region in the ORF of gene U9, the region in the ORF of gene U10, the region in the ORF of gene U12EX, the region in the ORF of gene U12, the region in the ORF of gene U13, the region in the ORF of gene U15, the region in the ORF of gene U16, the region in the ORF of gene U17, the region in the ORF of gene U18, the region in the ORF of gene U19, the region in the ORF of gene U20, the region in the ORF of gene U21, the region in the ORF of gene U22, the region in the ORF of gene U23, the region in the ORF of gene U24, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55, the region in the ORF of gene U58, the region in the ORF of gene U59, the region in the ORF of gene U61, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene U78, the region in the ORF of gene U79, the region in the ORF of gene U80, the region in the ORF of gene U81, the region in the ORF of gene U83, the region in the ORF of gene U84, the region in the ORF of gene U85, the region in the ORF of gene U88, the region in the ORF of gene U91, the region in the ORF of gene U92, the region in the ORF of gene U93, the region in the ORF of gene HN2, the region in the ORF of gene U94, the region in the ORF of gene U95, the region in the ORF of gene U96, the region flanking the ORF of gene LT1, the region flanking the ORF of gene DR1, the region flanking the ORF of gene DR2, the region flanking the ORF of gene DR3, the region flanking the ORF of gene DR4, the region flanking the ORF of gene DR5, the region flanking the ORF of gene DR6, the region flanking the ORF of gene DRHN1, the region flanking the ORF of gene DR7, the region flanking the ORF of gene DRHN2, the region flanking the ORF of gene DR8, the region flanking the ORF of gene LJ1, the region flanking the ORF of gene U1, the region flanking the ORF of gene U2, the region flanking the ORF of gene U3, the region flanking the ORF of gene U4, the region flanking the ORF of gene U5, the region flanking the ORF of gene U6, the region flanking the ORF of gene U7, the region flanking the ORF of gene U8, the region flanking the ORF of gene U9, the region flanking the ORF of gene U10, the region flanking the ORF of gene U12EX, the region flanking the ORF of gene U12, the region flanking the ORF of gene U13, the region flanking the ORF of gene U15, the region flanking the ORF of gene U16, the region flanking the ORF of gene U17, the region flanking the ORF of gene U18, the region flanking the ORF of gene U19, the region flanking the ORF of gene U20, the region flanking the ORF of gene U21, the region flanking the ORF of gene U22, the region flanking the ORF of gene U23, the region flanking the ORF of gene U24, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55, the region flanking the ORF of gene U58, the region flanking the ORF of gene U59, the region flanking the ORF of gene U61, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene U78, the region flanking the ORF of gene U79, the region flanking the ORF of gene U80, the region flanking the ORF of gene U81, the region flanking the ORF of gene U83, the region flanking the ORF of gene U84, the region flanking the ORF of gene U85, the region flanking the ORF of gene U88, the region flanking the ORF of gene U91, the region flanking the ORF of gene U92, the region flanking the ORF of gene U93, the region flanking the ORF of gene HN2, the region flanking the ORF of gene U94, the region flanking the ORF of gene U95, and the region flanking the ORF of gene U96.

83. The nucleic acid cassette of item 66, wherein each of the first fragment and the second fragment is independently at least 95% identical with the region selected from the group consisting of the following regions of herpesvirus HHV-6 genome:

the region in the ORF of gene LT1, the region in the ORF of gene DR1, the region in the ORF of gene DR2, the region in the ORF of gene DR3, the region in the ORF of gene DR4, the region in the ORF of gene DR5, the region in the ORF of gene DR6, the region in the ORF of gene DRHN1, the region in the ORF of gene DR7, the region in the ORF of gene DRHN2, the region in the ORF of gene DR8, the region in the ORF of gene LJ1, the region in the ORF of gene U1, the region in the ORF of gene U2, the region in the ORF of gene U3, the region in the ORF of gene U4, the region in the ORF of gene U5, the region in the ORF of gene U6, the region in the ORF of gene U7, the region in the ORF of gene U8, the region in the ORF of gene U9, the region in the ORF of gene U10, the region in the ORF of gene U12EX, the region in the ORF of gene U12, the region in the ORF of gene U13, the region in the ORF of gene U15, the region in the ORF of gene U16, the region in the ORF of gene U17, the region in the ORF of gene U18, the region in the ORF of gene U19, the region in the ORF of gene U20, the region in the ORF of gene U21, the region in the ORF of gene U22, the region in the ORF of gene U23, the region in the ORF of gene U24, the region in the ORF of gene U25, the region in the ORF of gene U26, the region in the ORF of gene U28, the region in the ORF of gene U32, the region in the ORF of gene U33, the region in the ORF of gene U34, the region in the ORF of gene U35, the region in the ORF of gene U36, the region in the ORF of gene U37, the region in the ORF of gene U40, the region in the ORF of gene U42, the region in the ORF of gene U44, the region in the ORF of gene U45, the region in the ORF of gene U46, the region in the ORF of gene U47, the region in the ORF of gene U49, the region in the ORF of gene U50, the region in the ORF of gene U51, the region in the ORF of gene U52, the region in the ORF of gene U55, the region in the ORF of gene U58, the region in the ORF of gene U59, the region in the ORF of gene U61, the region in the ORF of gene U62, the region in the ORF of gene U63, the region in the ORF of gene U64, the region in the ORF of gene U65, the region in the ORF of gene U67, the region in the ORF of gene U68, the region in the ORF of gene U69, the region in the ORF of gene U70, the region in the ORF of gene U71, the region in the ORF of gene U75, the region in the ORF of gene U76, the region in the ORF of gene U78, the region in the ORF of gene U79, the region in the ORF of gene U80, the region in the ORF of gene U81, the region in the ORF of gene U83, the region in the ORF of gene U84, the region in the ORF of gene U85, the region in the ORF of gene U88, the region in the ORF of gene U91, the region in the ORF of gene U92, the region in the ORF of gene U93, the region in the ORF of gene HN2, the region in the ORF of gene U94, the region in the ORF of gene U95, the region in the ORF of gene U96, the region flanking the ORF of gene LT1, the region flanking the ORF of gene DR1, the region flanking the ORF of gene DR2, the region flanking the ORF of gene DR3, the region flanking the ORF of gene DR4, the region flanking the ORF of gene DR5, the region flanking the ORF of gene DR6, the region flanking the ORF of gene DRHN1, the region flanking the ORF of gene DR7, the region flanking the ORF of gene DRHN2, the region flanking the ORF of gene DR8, the region flanking the ORF of gene LJ1, the region flanking the ORF of gene U1, the region flanking the ORF of gene U2, the region flanking the ORF of gene U3, the region flanking the ORF of gene U4, the region flanking the ORF of gene U5, the region flanking the ORF of gene U6, the region flanking the ORF of gene U7, the region flanking the ORF of gene U8, the region flanking the ORF of gene U9, the region flanking the ORF of gene U10, the region flanking the ORF of gene U12EX, the region flanking the ORF of gene U12, the region flanking the ORF of gene U13, the region flanking the ORF of gene U15, the region flanking the ORF of gene U16, the region flanking the ORF of gene U17, the region flanking the ORF of gene U18, the region flanking the ORF of gene U19, the region flanking the ORF of gene U20, the region flanking the ORF of gene U21, the region flanking the ORF of gene U22, the region flanking the ORF of gene U23, the region flanking the ORF of gene U24, the region flanking the ORF of gene U25, the region flanking the ORF of gene U26, the region flanking the ORF of gene U28, the region flanking the ORF of gene U32, the region flanking the ORF of gene U33, the region flanking the ORF of gene U34, the region flanking the ORF of gene U35, the region flanking the ORF of gene U36, the region flanking the ORF of gene U37, the region flanking the ORF of gene U40, the region flanking the ORF of gene U42, the region flanking the ORF of gene U44, the region flanking the ORF of gene U45, the region flanking the ORF of gene U46, the region flanking the ORF of gene U47, the region flanking the ORF of gene U49, the region flanking the ORF of gene U50, the region flanking the ORF of gene U51, the region flanking the ORF of gene U52, the region flanking the ORF of gene U55, the region flanking the ORF of gene U58, the region flanking the ORF of gene U59, the region flanking the ORF of gene U61, the region flanking the ORF of gene U62, the region flanking the ORF of gene U63, the region flanking the ORF of gene U64, the region flanking the ORF of gene U65, the region flanking the ORF of gene U67, the region flanking the ORF of gene U68, the region flanking the ORF of gene U69, the region flanking the ORF of gene U70, the region flanking the ORF of gene U71, the region flanking the ORF of gene U75, the region flanking the ORF of gene U76, the region flanking the ORF of gene U78, the region flanking the ORF of gene U79, the region flanking the ORF of gene U80, the region flanking the ORF of gene U81, the region flanking the ORF of gene U83, the region flanking the ORF of gene U84, the region flanking the ORF of gene U85, the region flanking the ORF of gene U88, the region flanking the ORF of gene U91, the region flanking the ORF of gene U92, the region flanking the ORF of gene U93, the region flanking the ORF of gene HN2, the region flanking the ORF of gene U94, the region flanking the ORF of gene U95, and the region flanking the ORF of gene U96.

84. The nucleic acid cassette of item 66, wherein the first fragment and the second fragment are derived from different regions.

85. The nucleic acid cassette of item 66, wherein each of the first fragment and the second fragment are independently from the region flanking the ORF of gene U24 of HHV-7, or the region flanking the ORF of gene U24a of HHV-7.

86. The nucleic acid cassette of item 66, wherein each of the first fragment and the second fragment are independently from the region flanking the ORF of gene U5 of HHV-6, or the region flanking the ORF of gene U8 of HHV-6.

87. The nucleic acid cassette of item 66, wherein the BAC vector sequence comprises a recombinant protein dependent recombinant sequence.

88. The nucleic acid cassette of item 66, wherein the BAC vector sequence comprises a selectable marker.

89. The nucleic acid cassette of item 88, wherein the selectable marker is drug selectable marker.

90. The nucleic acid cassette of item 88, wherein the selectable marker is a gene encoding green fluorescent protein.

91. The nucleic acid cassette of item 66, wherein the herpesvirus genome is derived from a wild type strain.

92. The nucleic acid cassette of item 66, wherein the herpesvirus genome is derived from a mutant type strain.

93. The nucleic acid cassette of item 66, wherein the herpesvirus genome is derived from HHV-7 KHR strain.

94. The nucleic acid cassette of item 66, wherein the herpesvirus genome is derived from HHV-6A U1102 strain or HHV-6B HST strain.

95. The nucleic acid cassette of item 66, wherein the BAC vector sequence comprises the sequence set forth in SEQ ID NO.: 401.

96. The nucleic acid cassette of item 66, having a nucleic acid sequence set forth in SEQ ID NO.: 1.

97. A pharmaceutical composition for prevention, treatment, or prognosis of HIV, comprising the recombinant herpesvirus of item 4.

98. A pharmaceutical composition for prevention of HIV, comprising the recombinant herpesvirus of item 4.

99. A pharmaceutical composition for prevention, treatment, or prognosis of HIV, comprising the recombinant herpesvirus of item 6.

100. A pharmaceutical composition for prevention of HIV, comprising the recombinant herpesvirus of item 6.

The present invention provides a recombinant herpesvirus, and a production method thereof. For example, the present invention provides a method for producing a recombinant herpesvirus from a single viral strain using a BAC (E. coli artificial chromosome), and a recombinant herpesvirus produced by the method. Further, the present invention provides a pharmaceutical composition comprising a recombinant herpesvirus.

Further, the present invention provides a vector comprising a herpes viral genomic gene and a BAC vector sequence, and a cell containing such a vector, and a nucleic acid cassette comprising a fragment capable of homologous recombination with a herpesvirus genome, and a BAC vector sequence.

Further, HHV-7 is known to have no adverse effect on healthy persons. Therefore, it is possible to select a protein, which is known to function as a vaccine, among various viral proteins, and incorporate it into recombinant HHV-7 in a manner such that the protein can be expressed. Thereby, a virus vaccine can be produced.

Further, a pharmaceutical composition for the prevention, treatment, and/or prognosis of HIV infection is provided, which comprises the recombinant HHV-7 and HHV-6 of the present invention.

BRIEF DESCRIPTION OF THE DRAWINGS

FIG. 1 is a schematic diagram showing the insertion of a BAC vector into the HHV-7 genome.

FIG. 2 shows the expression of GFP introduced into host cells using the recombinant HHV-7 of the present invention.

DESCRIPTION OF THE PREFERRED EMBODIMENTS

Hereinafter, the present invention will be described. It should be understood throughout the present specification that expression of a singular form includes the concept of their plurality unless otherwise mentioned. It should be also understood that the terms as used herein have definitions typically used in the art unless otherwise mentioned. Thus, unless otherwise defined, all scientific and technical terms have the same meanings as those generally used by those skilled in the art to which the present invention pertain. If there is contradiction, the present specification (including the definition) precedes.

Definition of Terms

The definitions of terms used herein are described below.

As used herein, the term "herpesvirus" includes all of HHV-6A, HHV-6B, and HHV-7, and both their wild-types and recombinant types unless otherwise mentioned. As used herein, the term "HHV-6" includes HHV-6A and HHV-6B, and both their wild-types and recombinant types unless otherwise mentioned.

As used herein, the term "essential gene" in relation to herpesvirus refers to a gene which is essential for the growth of the herpesvirus. Also, the term "non-essential gene" in relation to herpesvirus refers to a gene which is not essential for the growth of the herpesvirus, and in the absence of which the herpesvirus can grow.

(Human Herpesvirus 7; HHV-7)

Examples of non-essential genes of human herpesvirus 7 (HHV-7) include, but are not limited to: gene H1, gene DR1, gene DR2, gene H2, gene DR6, gene DR7, gene H3, gene H4, gene U2, gene U3, gene U4, gene U5/7, gene U8, gene U10, gene U12, gene U13, gene U15, gene U16, gene U17Ex, gene U17, gene U17a, gene U18, gene U19, gene U20, gene U21, gene U23, gene U24, gene U24a, gene U25, gene U26, gene U28, gene U32, gene U33, gene U34, gene U35, gene U36, gene U37, gene U40, gene U42, gene U44, gene U45, gene U46, gene U47, gene U49, gene U50, gene U51, gene U52, gene U55A, gene U55B, gene U58, gene U59, gene U62, gene U63, gene U64, gene U65, gene U67, gene U68, gene U69, gene U70, gene U71, gene U75, gene U76, gene H5, gene U79, gene H6, gene U80, gene U81, gene U84, gene U85, gene U91, gene H7, gene U95, and gene H8.

When a gene in a viral genome is an essential gene, the virus cannot grow in the absence of the gene. Therefore, by deleting an arbitrary gene in a viral genome and detecting the growth of the virus, it is possible to determine whether the gene is an essential gene or a non-essential gene.

A region within the ORF of the above-described non-essential gene and/or a region flanking the ORF, can be used as a target for inserting a BAC vector. Examples of such a preferable target include, but are not limited to, a region within or flanking the ORF of gene U24, and a region within or flanking the ORF of gene U24a. A region flanking the ORF of gene U24 and a region flanking the ORF of gene U24a are more preferable.

As used herein, the term "wild strain" in relation to herpesvirus refers to a herpesvirus strain which is not artificially modified and is isolated from the nature. An example of a wild strain includes, but is not limited to, strain JI. The nucleic acid sequence of strain JI is set forth in SEQ ID NO.: 1. The reading frame direction, the site on the genome, and the number of amino acid residues of a coded polypeptide of each ORF of strain JI are described below.

| ORF Name | Reading frame direction | Site on genome | Number of amino acid residues |
|---|---|---|---|
| H1 | 5'→3' direction | 33 to 542 | amino acid 1-170 |
| DR1 | 5'→3' direction | 368 to 826 | amino acid 1-153 |
| DR2 | 5'→3' direction | 898 to 2100 | amino acid 1-401 |
| H2 | 5'→3' direction | 2267 to 2506 | amino acid 1-80 |
| DR6 | 5'→3' direction | 2562 to 3050 | amino acid 1-163 |
| DR7 | 5'→3' direction | 3122 to 3910 | amino acid 1-263 |
| H3 | 3'→5' direction | 3976 to 4224 | amino acid 1-83 |
| H4 | 3'→5' direction | 4449 to 4745 | amino acid 1-99 |
| U2 | 3'→5' direction | 6338 to 7417 | amino acid 1-360 |
| U3 | 3'→5' direction | 7578 to 8732 | amino acid 1-385 |
| U4 | 3'→5' direction | 8754 to 10382 | amino acid 1-543 |
| U5/7 | 3'→5' direction | 10407 to 13004 | amino acid 1-866 |
| U8 | 3'→5' direction | 13174 to 14262 | amino acid 1-363 |
| U10 | 5'→3' direction | 14608 to 15963 | amino acid 1-452 |
| U11 | 3'→5' direction | 15982 to 18249 | amino acid 1-756 |
| U12 | 5'→3' direction | 18396 to 19436 | amino acid 1-347 |
| U13 | 5'→3' direction | 19521 to 19817 | amino acid 1-99 |
| U14 | 5'→3' direction | 19885 to 21831 | amino acid 1-649 |
| U15 | 3'→5' direction | 22244 to 22564 | amino acid 1-107 |
| U17Ex | 3'→5' direction | 22772-23547 & 23620-23836 | amino acid 1-331 |
| U17 | 3'→5' direction | 23570 to 23836 | amino acid 1-89 |
| U17a | 5'→3' direction | 24318 to 24587 | amino acid 1-90 |
| U18 | 3'→5' direction | 24713 to 25600 | amino acid 1-296 |
| U19 | 3'→5' direction | 25945 to 26922 | amino acid 1-326 |
| U20 | 3'→5' direction | 27036 to 28211 | amino acid 1-392 |
| U21 | 3'→5' direction | 28202 to 29494 | amino acid 1-431 |
| U23 | 3'→5' direction | 29903 to 30418 | amino acid 1-172 |
| U24 | 3'→5' direction | 30524 to 30772 | amino acid 1-83 |
| U24a | 3'→5' direction | 30776 to 31129 | amino acid 1-118 |
| U25 | 3'→5' direction | 30936 to 31898 | amino acid 1-321 |
| U26 | 3'→5' direction | 31988 to 32869 | amino acid 1-294 |
| 8 | 3'→5' direction | 34064 to 36484 | amino acid 1-807 |
| U29 | 3'→5' direction | 36487 to 37347 | amino acid 1-287 |
| U30U27 | 3'→5' direction | 32857 to 33951 | amino acid 1-365 |
| U2 | 5'→3' direction | 37362 to 40178 | amino acid 1-939 |
| U31 | 3'→5' direction | 40179 to 46358 | amino acid 1-2060 |
| U32 | 3'→5' direction | 46355 to 46627 | amino acid 1-91 |
| U33 | 3'→5' direction | 46608 to 48041 | amino acid 1-478 |
| U34 | 3'→5' direction | 47992 to 48768 | amino acid 1-259 |
| U35 | 3'→5' direction | 48805 to 49119 | amino acid 1-105 |
| U36 | 5'→3' direction | 49118 to 50575 | amino acid 1-486 |
| U37 | 5'→3' direction | 50577 to 51356 | amino acid 1-260 |
| U38 | 3'→5' direction | 51363 to 54401 | amino acid 1-1013 |
| U39 | 3'→5' direction | 54401 to 56869 | amino acid 1-823 |
| U40 | 3'→5' direction | 56832 to 58997 | amino acid 1-722 |
| U41 | 3'→5' direction | 59000 to 62395 | amino acid 1-1132 |
| U42 | 3'→5' direction | 62772 to 64352 | amino acid 1-527 |
| U43 | 3'→5' direction | 64501 to 67086 | amino acid 1-862 |
| U44 | 5'→3' direction | 67143 to 67754 | amino acid 1-204 |
| U45 | 3'→5' direction | 67759 to 68898 | amino acid 1-380 |
| U46 | 5'→3' direction | 68930 to 69190 | amino acid 1-87 |
| U47 | 3'→5' direction | 69638 to 70579 | amino acid 1-314 |
| U48 | 3'→5' direction | 70817 to 72889 | amino acid 1-691 |
| U49 | 5'→3' direction | 73003 to 73722 | amino acid 1-240 |
| U50 | 5'→3' direction | 73538 to 75202 | amino acid 1-555 |
| U51 | 5'→3' direction | 75304 to 76188 | amino acid 1-295 |
| U52 | 3'→5' direction | 76185 to 76949 | amino acid 1-255 |
| U53 | 5'→3' direction | 76957 to 78495 | amino acid 1-513 |
| U54 | 3'→5' direction | 78503 to 79870 | amino acid 1-456 |
| U55A | 3'→5' direction | 79918 to 81201 | amino acid 1-428 |
| U55B | 3'→5' direction | 81285 to 82577 | amino acid 1-431 |
| U56 | 3'→5' direction | 82630 to 83511 | amino acid 1-294 |
| U57 | 3'→5' direction | 83514 to 87551 | amino acid 1-1346 |
| U58 | 5'→3' direction | 87563 to 89890 | amino acid 1-776 |
| U59 | 5'→3' direction | 89838 to 90881 | amino acid 1-348 |
| U60-U66 | 3'→5' direction | 90878-92005 & 95122-95985 | amino acid 1-664 |
| U62 | 5'→3' direction | 92017 to 92244 | amino acid 1-76 |
| U63 | 5'→3' direction | 92216 to 92851 | amino acid 1-212 |
| U64 | 5'→3' direction | 92829 to 94148 | amino acid 1-440 |
| U65 | 5'→3' direction | 94111 to 95103 | amino acid 1-331 |
| U67 | 5'→3' direction | 95984 to 97024 | amino acid 1-347 |

-continued

| ORF Name | Reading frame direction | Site on genome | Number of amino acid residues |
|---|---|---|---|
| U68 | 5'→3' direction | 97024 to 97368 | amino acid 1-115 |
| U69 | 5'→3' direction | 97371 to 99011 | amino acid 1-547 |
| U70 | 5'→3' direction | 99013 to 100455 | amino acid 1-481 |
| U71 | 5'→3' direction | 100392 to 100613 | amino acid 1-74 |
| U72 | 3'→5' direction | 100636 to 101676 | amino acid 1-347 |
| U73 | 5'→3' direction | 101693 to 104056 | amino acid 1-788 |
| U74 | 5'→3' direction | 104007 to 105986 | amino acid 1-660 |
| U75 | 3'→5' direction | 105973 to 106743 | amino acid 1-257 |
| U76 | 3'→5' direction | 106667 to 108589 | amino acid 1-641 |
| U77 | 5'→3' direction | 108435 to 110897 | amino acid 1-821 |
| H5 | 5'→3' direction | 112811 to 113311 | amino acid 1-167 |
| U79 | 5'→3' direction | 113502 to 114203 | amino acid 1-234 |
| H6 | 5'→3' direction | 114257 to 114505 | amino acid 1-83 |
| U80 | 5'→3' direction | 114557 to 115189 | amino acid 1-211 |
| U81 | 3'→5' direction | 115184 to 115948 | amino acid 1-255 |
| U82 | 3'→5' direction | 116038 to 116778 | amino acid 1-247 |
| U84 | 3'→5' direction | 117111 to 118043 | amino acid 1-311 |
| U85 | 3'→5' direction | 118071 to 118913 | amino acid 1-281 |
| U86 | 3'→5' direction | 119091 to 122708 | amino acid 1-1206 |
| U89 | 3'→5' direction | 125420 to 128668 | amino acid 1-1083 |
| U90 | 3'→5' direction | 128776 to 129051 | amino acid 1-92 |
| U91 | 5'→3' direction | 129122 to 129625 | amino acid 1-168 |
| H7 | 5'→3' direction | 130829 to 132112 | amino acid 1-428 |
| U95 | 5'→3' direction | 133382 to 136204 | amino acid 1-941 |
| H8 | 3'→5' direction | 136307 to 136579 | amino acid 1-91 |
| U98 | 3'→5' direction | 137945 to 138451 | amino acid 1-169 |
| U99 | 3'→5' direction | 138375 to 138692 | amino acid 1-106 |
| U100 | 3'→5' direction | 138751 to 138999 | amino acid 1-83 |
| H1' | 5'→3' direction | 139080 to 139589 | amino acid 1-170 |
| DR1' | 5'→3' direction | 139415 to 139873 | amino acid 1-153 |
| DR2' | 5'→3' direction | 139945 to 141147 | amino acid 1-401 |
| H2' | 5'→3' direction | 141314 to 141553 | amino acid 1-80 |
| DR6' | 5'→3' direction | 141609 to 142097 | amino acid 1-163 |
| DR7' | 5'→3' direction | 142169 to 142957 | amino acid 1-263 |
| H3' | 3'→5' direction | 143023 to 143271 | amino acid 1-83 |
| H4' | 3'→5' direction | 143496 to 143792 | amino acid 1-99. |

In the above-described table, "5'→3' direction" indicates that the ORF has the same direction as that of the nucleic acid sequence of SEQ ID NO.: 1. "3'→5' direction" indicates that the ORF has a reverse direction with respect to that of the nucleic acid sequence of SEQ ID NO.: 1. By identifying a sequence homologous to the nucleic acid sequence and/or the amino acid sequence of the ORF, those skilled in the art can easily identify the ORF in the genome of a strain other than strain JI.

Features of a gene product coded by each ORF in the HHV-7 genome are described in Tables 1 to 3 below.

TABLE 1

Non-essential genes of HHV-7

| ORF | Amino acid residue length | Features |
|---|---|---|
| H1 | 169 | — |
| DR1 | 152 | US22 gene family, DR1/6 homolog |
| DR2 | 400 | US22 gene family |
| H2 | 79 | — |
| DR6 | 161 | US22 gene family, DR1/6 homolog |
| DR7 | 262 | US22 gene family, transcription activating agent |
| H3 | 82 | — |
| H4 | 98 | — |
| U2 | 359 | US22 gene family |
| U3 | 384 | US22 gene family |
| U4 | 542 | — |
| U5/7 | 865 | US22 gene family |
| U8 | 362 | US22 gene family |
| U10 | 451 | — |

TABLE 1-continued

Non-essential genes of HHV-7

| ORF | Amino acid residue length | Features |
|---|---|---|
| U12 | 346 | GCR homolog, chemokine receptor |
| U13 | 98 | |
| U15 | 106 | |
| U16 | 264 | IE-B transcription activating agent (spliced into U17) |
| U17Ex | 72 | IE-B transcription activating agent (spliced into U16) |
| U17 | 88 | |
| U17a | 89 | |
| U18 | 295 | IE-B, HCMV IE glycoprotein homolog |
| U19 | 325 | IE-B |
| U20 | 391 | Ig gene family? |
| U21 | 430 | glycoprotein |
| U23 | 171 | glycoprotein, EHV-1 gJ homolog |
| U24 | 82 | glycoprotein |
| U24a | 117 | |
| U25 | 320 | US22 gene family, transcription activating agent |
| U26 | 293 | |
| U28 | 806 | ribonucleotide reductase (large subunit) |
| U32 | 90 | |
| U33 | 477 | virion protein |
| U34 | 258 | virion protein? |
| U35 | 104 | |
| U36 | 485 | considered to be virion protein |
| U37 | 259 | |
| U40 | 721 | transport protein |
| U42 | 526 | transcription activating agent |
| U44 | 203 | |
| U45 | 379 | dUTPase |
| U46 | 86 | |
| U47 | 313 | |
| U49 | 239 | fusion protein |
| U50 | 554 | virion protein |
| U51 | 294 | GCR, opioid homolog |
| U52 | 254 | |
| U55A | 427 | replication function? |
| U55B | 430 | replication function? |
| U58 | 775 | |
| U59 | 347 | |
| U62 | 75 | |
| U63 | 211 | |
| U64 | 439 | |
| U65 | 330 | |
| U67 | 346 | |
| U68 | 114 | |
| U69 | 546 | phosphotransferase |
| U70 | 480 | alkali exonuclease |
| U71 | 73 | |
| U75 | 256 | |
| U76 | 640 | virion protein? |
| H5 | 166 | |
| U79 | 233 | HCMV replication, spliced (UL112/113) |
| H6 | 82 | homolog of C-terminus of U79 of HHV-6 |
| U80 | 210 | HCMV replication, spliced (UL112/113) |
| U81 | 254 | uracil-DNA glycosylase |
| U84 | 310 | splised in HCMV |
| U85 | 280 | homolog of OX-2 glycoprotein |
| U91 | 167 | |
| H7 | 427 | DraI repeat |
| U95 | 940 | MCMV IE2 homolog, US22 gene family |
| H8 | 90 | |

TABLE 2

HHV-7 genes involved in viral replication

| ORF | Amino acid residue length | Features |
|---|---|---|
| U27 | 364 | polymerase promoting agent |
| U38 | 1,012 | DNA polymerase |

TABLE 2-continued

HHV-7 genes involved in viral replication

| ORF | Amino acid residue length | Features |
|---|---|---|
| U41 | 1,131 | single stranded DNA-binding protein |
| U43 | 861 | primase |
| U73 | 787 | origin binding protein (OBP) |
| U74 | 659 | helicase/primase complex |
| U77 | 820 | helicase |
| U86 | 1,205 | homology to IE-A, HCMV IE2 |
| U89 | 1,082 | IE-A transcription activating agent |
| U90 | 91 | exon in IE-A, HHV-6 |

TABLE 3

HHV-7 genes involved in formation of viral particle

| ORF | Amino acid residue length | Features |
|---|---|---|
| U11 | 755 | structural phophorylated protein |
| U14 | 648 | HCMV UL25/35 gene family |
| U29 | 286 | minor capsid protein (mCP) |
| U30 | 938 | capsid assembly, myosin agent involved in association and formation of capsid (part of viral particle) |
| U31 | 2,059 | large tegument protein |
| U39 | 822 | glycoprotein B (gB) |
| U48 | 690 | glycoprotein H (gH) |
| U53 | 512 | protease/assembly protein |
| U54 | 455 | tegument protein, transcription activating agent |
| U56 | 293 | capsid protein |
| U57 | 1,345 | major capsid protein (MCP) |
| U60 | 394 | spliced in later phase (U60/66) protein involved in DNA packaging |
| U66 | 309 | spliced in later phase (U60/66) protein involved in DNA packaging |
| U72 | 346 | intramembranous protein (gM) |
| U82 | 246 | glycoprotein L (gL) |
| U98 | 168 | protein homologous to HHV-6 gQ |
| U99 | 105 | protein homologous to HHV-6 gQ |
| U100 | 82 | protein homologous to HHV-6 gQ |

(Human Herpesvirus 6a; HHV-6a)

Examples of non-essential genes of human herpesvirus 6 (HHV-6A) include, but are not limited to, gene LT1, gene DR1, gene DR2, gene DR3, gene DR4, gene DR5, gene DR6, gene DRHN1, gene DR7, gene DRHN2, gene DR8, gene LJ1, gene U1, gene U2, gene U3, gene U4, gene U5, gene U6, gene U7, gene U8, gene U9, gene U10, gene U12EX, gene U12, gene U13, gene U15, gene U16, gene U17, gene U18, gene U19, gene U20, gene U21, gene U22, gene U23, gene U24, gene U25, gene U26, gene U28, gene U32, gene U33, gene U34, gene U35, gene U36, gene U37, gene U40, gene U42, gene U44, gene U45, gene U46, gene U47, gene U49, gene U50, gene U51, gene U52, gene U55, gene U58, gene U59, gene U61, gene U62, gene U63, gene U64, gene U65, gene U67, gene U68, gene U69, gene U70, gene U71, gene U75, gene U76, gene U78, gene U79, gene U80, gene U81, gene U83, gene U84, gene U85, gene U88, gene U91, gene U92, gene U93, gene HN2, gene U94, gene U95, and gene U96.

When a gene in a viral genome is an essential gene, the virus cannot grow in the absence of the gene. Therefore, by deleting an arbitrary gene in a viral genome and detecting the growth of the virus, it is possible to determine whether the gene is an essential gene or a non-essential gene.

A region within the ORF of the above-described non-essential gene and/or a region flanking the ORF, can be used as a target for inserting a BAC vector. Examples of such a preferable target include, but are not limited to, a region within or flanking the ORF of gene U5, and a region within or flanking the ORF of gene U8. A region flanking the ORF of gene U5 and a region flanking the ORF of gene U8 are more preferable.

As used herein, the term "wild strain" in relation to HHV-6A refers to a HHV-6A strain which is not artificially modified and is isolated from the nature. An example of a wild strain includes, but is not limited to, strain U1102. The nucleic acid sequence of strain U1102 is set forth in SEQ ID NO.: 128. The reading frame direction, the site on the genome, and the number of amino acid residues of a coded polypeptide of each ORF of strain U1102 are described below.

| ORF Name | Reading frame direction | Site on genome | Number of amino acid residues |
|---|---|---|---|
| LT1 | 3'→5' direction | 1 to 338 | amino acid 1-113 |
| DR1 | 5'→3' direction | 501 to 794 | amino acid 1-98 |
| DR2 | 5'→3' direction | 791 to 2653 | amino acid 1-621 |
| DR3 | 3'→5' direction | 2401 to 2979 | amino acid 1-193 |
| DR4 | 5'→3' direction | 2746 to 3048 | amino acid 1-101 |
| DR5 | 3'→5' direction | 3734 to 4171 | amino acid 1-146 |
| DR6 | 5'→3' direction | 4725 to 5036 | amino acid 1-104 |
| DR7 | 5'→3' direction | 5629 to 6720 | amino acid 1-364 |
| DR8 | 5'→3' direction | 7237 to 7569 | amino acid 1-111 |
| LJ1 | 3'→5' direction | 7467 to 8432 | amino acid 1-322 |
| U1 | 5'→3' direction | 8245 to 8616 | amino acid 1-124 |
| U2 | 3'→5' direction | 8716 to 9816 | amino acid 1-367 |
| U3 | 3'→5' direction | 10155 to 11276 | amino acid 1-374 |
| U4 | 3'→5' direction | 11485 to 13092 | amino acid 1-536 |
| U5 | 3'→5' direction | 13214 to 14548 | amino acid 1-445 |
| U6 | 5'→3' direction | 14619 to 14867 | amino acid 1-83 |
| U7 | 3'→5' direction | 14908 to 15936 | amino acid 1-343 |
| U8 | 3'→5' direction | 16021 to 17091 | amino acid 1-357 |
| U9 | 3'→5' direction | 17238 to 17552 | amino acid 1-105 |
| U10 | 5'→3' direction | 17604 to 18914 | amino acid 1-437 |
| U11 | 3'→5' direction | 18966 to 21578 | amino acid 1-871 |
| U12 exon 1-2 | 5'→3' direction | 21680-21710 & 21800-22812 | amino acid 1-348 |
| U12 | 5'→3' direction | 21856 to 22812 | amino acid 1-319 |
| U13 | 5'→3' direction | 22898 to 23218 | amino acid 1-107 |
| U14 | 5'→3' direction | 23316 to 25145 | amino acid 1-610 |
| U15 | 3'→5' direction | 25660 to 25992 | amino acid 1-111 |
| U16 exon 1-2 | 3'→5' direction | 26259-27034 & 27187-27349 | amino acid 1-313 |
| U16 | 3'→5' direction | 26259 to 27116 | amino acid 1-286 |
| U17 | 3'→5' direction | 26948 to 27349 | amino acid 1-134 |
| U18 | 3'→5' direction | 28508 to 29389 | amino acid 1-294 |
| U19 | 3'→5' direction | 29649 to 30818 | amino acid 1-390 |
| U20 | 3'→5' direction | 31069 to 32337 | amino acid 1-423 |
| U21 | 3'→5' direction | 32340 to 33641 | amino acid 1-434 |
| U22 | 3'→5' direction | 33739 to 34347 | amino acid 1-203 |
| U23 | 3'→5' direction | 34375 to 35085 | amino acid 1-237 |
| U24 | 3'→5' direction | 35392 to 35655 | amino acid 1-88 |
|  | 3'→5' direction | 35674 to 35847 | amino acid 1-58 |
| U25 | 3'→5' direction | 35864 to 36814 | amino acid 1-317 |
| U26 | 3'→5' direction | 36922 to 37809 | amino acid 1-296 |
| U27 | 3'→5' direction | 37797 to 38978 | amino acid 1-394 |
| U28 | 3'→5' direction | 39020 to 41434 | amino acid 1-805 |
| U29 | 3'→5' direction | 41457 to 42356 | amino acid 1-300 |
| U30 | 5'→3' direction | 41884 to 45132 | amino acid 1-1083 |
| U31 | 5'→3' direction | 45150 to 51383 | amino acid 1-2078 |
| U32 | 3'→5' direction | 51455 to 51721 | amino acid 1-89 |
| U33 | 3'→5' direction | 51723 to 53135 | amino acid 1-471 |
| U34 | 3'→5' direction | 53086 to 53916 | amino acid 1-277 |
| U35 | 3'→5' direction | 53933 to 54253 | amino acid 1-107 |
| U36 | 5'→3' direction | 54252 to 55706 | amino acid 1-485 |
| U37 | 5'→3' direction | 55710 to 56504 | amino acid 1-265 |
| U38 | 3'→5' direction | 56550 to 59588 | amino acid 1-1013 |
| U39 | 3'→5' direction | 59588 to 62080 | amino acid 1-831 |
| U40 | 3'→5' direction | 62034 to 64214 | amino acid 1-727 |
| U41 | 3'→5' direction | 64222 to 67620 | amino acid 1-1133 |
| U42 | 3'→5' direction | 69054 to 70598 | amino acid 1-515 |
| U43 | 3'→5' direction | 70823 to 73405 | amino acid 1-861 |

-continued

| ORF Name | Reading frame direction | Site on genome | Number of amino acid residues |
|---|---|---|---|
| U44 | 5'→3' direction | 73446 to 74087 | amino acid 1-214 |
| U45 | 3'→5' direction | 74088 to 75218 | amino acid 1-377 |
| U46 | 5'→3' direction | 75291 to 75545 | amino acid 1-85 |
| U47 | 3'→5' direction | 75912 to 77867 | amino acid 1-652 |
| U48 | 3'→5' direction | 78034 to 80118 | amino acid 1-695 |
| U49 | 5'→3' direction | 80277 to 81035 | amino acid 1-253 |
| U50 | 5'→3' direction | 80812 to 82479 | amino acid 1-556 |
| U51 | 5'→3' direction | 82574 to 83479 | amino acid 1-302 |
| U52 | 3'→5' direction | 83498 to 84274 | amino acid 1-259 |
| U53 | 5'→3' direction | 84281 to 85867 | amino acid 1-529 |
| U54 | 3'→5' direction | 86051 to 87427 | amino acid 1-459 |
| U55 | 3'→5' direction | 87505 to 88803 | amino acid 1-433 |
| U56 | 3'→5' direction | 88983 to 89873 | amino acid 1-297 |
| U57 | 3'→5' direction | 89875 to 93912 | amino acid 1-1346 |
| U58 | 5'→3' direction | 93924 to 96242 | amino acid 1-773 |
| U59 | 5'→3' direction | 96239 to 97291 | amino acid 1-351 |
| U60 | 3'→5' direction | 97288 to 98256 | amino acid 1-323 |
| U61 | 3'→5' direction | 98231 to 98578 | amino acid 1-116 |
| U62 | 5'→3' direction | 98427 to 98684 | amino acid 1-86 |
| U63 | 5'→3' direction | 98632 to 99282 | amino acid 1-217 |
| U64 | 5'→3' direction | 99260 to 100588 | amino acid 1-443 |
| U65 | 5'→3' direction | 100545 to 101552 | amino acid 1-336 |
| U66 | 3'→5' direction | 101569 to 102486 | amino acid 1-306 |
| U67 | 5'→3' direction | 102458 to 103519 | amino acid 1-354 |
| U68 | 5'→3' direction | 103519 to 103863 | amino acid 1-115 |
| U69 | 5'→3' direction | 103866 to 105554 | amino acid 1-563 |
| U70 | 5'→3' direction | 105562 to 107028 | amino acid 1-489 |
| U71 | 5'→3' direction | 106965 to 107198 | amino acid 1-78 |
| U72 | 3'→5' direction | 107278 to 108312 | amino acid 1-345 |
| U73 | 5'→3' direction | 108325 to 110667 | amino acid 1-781 |
| U74 | 5'→3' direction | 110636 to 112624 | amino acid 1-663 |
| U75 | 3'→5' direction | 112659 to 113408 | amino acid 1-250 |
| U76 | 3'→5' direction | 113317 to 115305 | amino acid 1-663 |
| U77 | 5'→3' direction | 115100 to 117574 | amino acid 1-825 |
| U78 | 3'→5' direction | 118709 to 119038 | amino acid 1-110 |
| U79 | 5'→3' direction | 120164 to 121198 | amino acid 1-345 |
| U80 | 5'→3' direction | 121170 to 121766 | amino acid 1-199 |
| U81 | 3'→5' direction | 121810 to 122577 | amino acid 1-256 |
| U82 | 3'→5' direction | 122653 to 123405 | amino acid 1-251 |
| U83 | 5'→3' direction | 123528 to 123821 | amino acid 1-98 |
| U84 | 3'→5' direction | 123925 to 124953 | amino acid 1-343 |
| U85 | 3'→5' direction | 124981 to 125853 | amino acid 1-291 |
| U86 | 3'→5' direction | 125989 to 128136 | amino acid 1-716 |
| U87 | 3'→5' direction | 127551 to 130043 | amino acid 1-831 |
| U88 | 5'→3' direction | 131034 to 132275 | amino acid 1-414 |
| U89 | 3'→5' direction | 133091 to 135610 | amino acid 1-840 |
| U90 | 3'→5' direction | 135664 to 135948 | amino acid 1-95 |
| Putative protein U90 | 5'→3' direction | 136266 to 136481 | amino acid 1-72 |
| U91 | 5'→3' direction | 136485 to 136829 | amino acid 1-115 |
| U92 | 3'→5' direction | 138049 to 138492 | amino acid 1-148 |
| U93 | 3'→5' direction | 138531 to 139124 | amino acid 1-198 |
| U94 | 3'→5' direction | 141394 to 142866 | amino acid 1-491 |
| U95 | 5'→3' direction | 142941 to 146306 | amino acid 1-1122 |
| U96 | 3'→5' direction | 146641 to 146940 | amino acid 1-100 |
| U97 | 3'→5' direction | 147808 to 148077 | amino acid 1-90 |
| U98 | 3'→5' direction | 148741 to 149391 | amino acid 1-217 |
| U99 | 3'→5' direction | 149485 to 149766 | amino acid 1-94 |
| U100 | 3'→5' direction | 149868 to 150437 | amino acid 1-190 |
| RJ1 | 3'→5' direction | 151140 to 151571 | amino acid 1-144 |
| DR1 | 5'→3' direction | 151734 to 152027 | amino acid 1-98 |
| DR2 | 5'→3' direction | 152024 to 153886 | amino acid 1-621 |
| DR3 | 3'→5' direction | 153634 to 154212 | amino acid 1-193 |
| DR4 | 5'→3' direction | 153979 to 154281 | amino acid 1-101 |
| DR5 | 3'→5' direction | 154967 to 155404 | amino acid 1-146 |
| DR6 | 5'→3' direction | 155958 to 156269 | amino acid 1-104 |
| DR7 | 5'→3' direction | 156862 to 157953 | amino acid 1-364 |
| DR8 | 5'→3' direction | 158470 to 158802 | amino acid 1-111 |

In the above-described table, "5'→3' direction" indicates that the ORF has the same direction as that of the nucleic acid sequence of SEQ ID NO.: 128. "3'→5' direction" indicates that the ORF has a reverse direction with respect to that of the nucleic acid sequence of SEQ ID NO.: 128. By identifying a sequence homologous to the nucleic acid sequence and/or the amino acid sequence of the ORF, those skilled in the art can easily identify the ORF in the genome of a strain other than strain U1102.

As used herein, the term "mutant strain" refers to a herpesvirus strain which has a mutation due to mutagenesis, multiple subculturings or the like. Mutagenesis of a herpesvirus strain may be either random mutagenesis or site-specific mutagenesis.

(Human Herpesvirus 6B; HHV-6B)

Examples of non-essential genes which are considered to be of HHV-6B having substantially the same genome structure as that of HHV-6A, include, but are not limited to: gene LT1, gene DR1, gene DR2, gene DR3, gene DR4, gene DR5, gene DR6, gene DRHN1, gene DR7, gene DRHN2, gene DR8, gene LJ1, gene U1, gene U2, gene U3, gene U4, gene U5, gene U6, gene U7, gene U8, gene U9, gene U10, gene U12EX, gene U12, gene U13, gene U15, gene U16, gene U17, gene U18, gene U19, gene U20, gene U21, gene U22, gene U23, gene U24, gene U25, gene U26, gene U28, gene U32, gene U33, gene U34, gene U35, gene U36, gene U37, gene U40, gene U42, gene U44, gene U45, gene U46, gene U47, gene U49, gene U50, gene U51, gene U52, gene U55, gene U58, gene U59, gene U61, gene U62, gene U63, gene U64, gene U65, gene U67, gene U68, gene U69, gene U70, gene U71, gene U75, gene U76, gene U78, gene U79, gene U80, gene U81, gene U83, gene U84, gene U85, gene U88, gene U91, gene U92, gene U93, gene HN2, gene U94, gene U95, and gene U96.

When a gene in a viral genome is an essential gene, the virus cannot grow in the absence of the gene. Therefore, by deleting an arbitrary gene in a viral genome and detecting the growth of the virus, it is possible to determine whether the gene is an essential gene or a non-essential gene.

A region within the ORF of the above-described non-essential gene and/or a region flanking the ORF, can be used as a target for inserting a BAC vector. Examples of such a preferable target include, but are not limited to, a region within or flanking the ORF of gene U5, and a region within or flanking the ORF of gene U8. A region flanking the ORF of gene U5 and a region flanking the ORF of gene U8 are more preferable.

As used herein, the term "wild strain" in relation to HHV-6B refers to a HHV-6B strain which is not artificially modified and is isolated from the nature. An example of a wild strain includes, but is not limited to, strain HST. The nucleic acid sequence of strain HST is set forth in SEQ ID NO.: 272. The reading frame direction, the site on the genome, and the number of amino acid residues of a coded polypeptide of each ORF of strain HST are described below.

| ORF Name | Reading frame direction | Site on genome | Number of amino acid residues |
|---|---|---|---|
| LT1 | 3'→5' direction | 18 to 365 | amino acid 1-116 |
| DR1 | 5'→3' direction | 576 to 842 | amino acid 1-89 |
| DR2 | 5'→3' direction | 1027 to 2970 | amino acid 1-648 |
| DR3 | 3'→5' direction | 2718 to 3320 | amino acid 1-201 |
| DRHN1 | 3'→5' direction | 5023 to 5532 | amino acid 1-170 |
| DR6 | 5'→3' direction | 5025 to 5336 | amino acid 1-104 |
| DR7 | 5'→3' direction | 6512 to 7150 | amino acid 1-213 |
| DRHN2 | 3'→5' direction | 7236 to 7706 | amino acid 1-157 |
| D | 5'→3' direction | 7928 to 8662 | amino acid 1-245 |
| LJ1 | 3'→5' direction | 8292 to 8807 | amino acid 1-172 |
| U1 | 5'→3' direction | 8929 to 9384 | amino acid 1-152 |
| U2 | 3'→5' direction | 9467 to 10768 | amino acid 1-434 |
| U3 | 3'→5' direction | 10891 to 12051 | amino acid 1-387 |
| U4 | 3'→5' direction | 12276 to 13883 | amino acid 1-536 |

-continued

| ORF Name | Reading frame direction | Site on genome | Number of amino acid residues |
|---|---|---|---|
| U5 | 3'→5' direction | 14002 to 15333 | amino acid 1-444 |
| U6 | 5'→3' direction | 15395 to 15652 | amino acid 1-86 |
| U7 | 3'→5' direction | 15678 to 16802 | amino acid 1-375 |
| U8 | 3'→5' direction | 16806 to 18041 | amino acid 1-412 |
| U9 | 3'→5' direction | 18022 to 18336 | amino acid 1-105 |
| U10 | 5'→3' direction | 18386 to 19897 | amino acid 1-504 |
| U11 | 3'→5' direction | 19801 to 22377 | amino acid 1-859 |
| U12 | 5'→3' direction | 22479-22511 & 22589-23617 | amino acid 1-354 |
| U13 | 5'→3' direction | 23699 to 24022 | amino acid 1-108 |
| U14 | 5'→3' direction | 24136 to 25953 | amino acid 1-606 |
| U15 | 3'→5' direction | 26559 to 26891 | amino acid 1-111 |
| U16 | 3'→5' direction | 27172 to 27603 | amino acid 1-144 |
| U17 | 3'→5' direction | 28003 to 28263 | amino acid 1-87 |
| U18 | 3'→5' direction | 29443 to 30327 | amino acid 1-295 |
| U19 | 3'→5' direction | 30592 to 31761 | amino acid 1-390 |
| U20 | 3'→5' direction | 31984 to 33288 | amino acid 1-435 |
| U21 | 3'→5' direction | 33291 to 34793 | amino acid 1-501 |
| U22 | 3'→5' direction | 34690 to 35298 | amino acid 1-203 |
| U23 | 3'→5' direction | 35326 to 36225 | amino acid 1-300 |
| U24 | 3'→5' direction | 36350 to 36616 | amino acid 1-89 |
| U25 | 3'→5' direction | 36825 to 37775 | amino acid 1-317 |
| U26 | 3'→5' direction | 37883 to 38770 | amino acid 1-296 |
| U27 | 3'→5' direction | 38758 to 39933 | amino acid 1-392 |
| U28 | 3'→5' direction | 39975 to 42389 | amino acid 1-805 |
| U29 | 3'→5' direction | 42412 to 43311 | amino acid 1-300 |
| U30 | 5'→3' direction | 42839 to 46087 | amino acid 1-1083 |
| U31 | 5'→3' direction | 46105 to 52338 | amino acid 1-2078 |
| U32 | 3'→5' direction | 52412 to 52681 | amino acid 1-90 |
| U33 | 3'→5' direction | 52683 to 54095 | amino acid 1-471 |
| U34 | 3'→5' direction | 54046 to 54876 | amino acid 1-277 |
| U35 | 3'→5' direction | 54893 to 55210 | amino acid 1-106 |
| U36 | 3'→5' direction | 55212 to 56660 | amino acid 1-483 |
| U37 | 5'→3' direction | 56664 to 57458 | amino acid 1-265 |
| U38 | 3'→5' direction | 57504 to 60542 | amino acid 1-1013 |
| U39 | 3'→5' direction | 60542 to 63034 | amino acid 1-831 |
| U40 | 3'→5' direction | 62988 to 65168 | amino acid 1-727 |
| U41 | 3'→5' direction | 65176 to 68574 | amino acid 1-1133 |
| U42 | 3'→5' direction | 69937 to 71487 | amino acid 1-517 |
| U43 | 3'→5' direction | 71712 to 74294 | amino acid 1-861 |
| U44 | 5'→3' direction | 74335 to 75030 | amino acid 1-232 |
| U45 | 3'→5' direction | 74977 to 76107 | amino acid 1-377 |
| U46 | 5'→3' direction | 76180 to 76434 | amino acid 1-85 |
| U47 | 3'→5' direction | 76617 to 78833 | amino acid 1-739 |
| U48 | 3'→5' direction | 79099 to 81183 | amino acid 1-695 |
| U49 | 5'→3' direction | 81342 to 82100 | amino acid 1-253 |
| U50 | 5'→3' direction | 81877 to 83544 | amino acid 1-556 |
| U51 | 5'→3' direction | 83642 to 84547 | amino acid 1-302 |
| U52 | 3'→5' direction | 84744 to 85343 | amino acid 1-200 |
| U53 | 5'→3' direction | 85350 to 86936 | amino acid 1-529 |
| U54 | 3'→5' direction | 87171 to 88550 | amino acid 1-460 |
| U55 | 3'→5' direction | 88628 to 90106 | amino acid 1-493 |
| U56 | 3'→5' direction | 90107 to 90997 | amino acid 1-297 |
| U57 | 3'→5' direction | 90999 to 95036 | amino acid 1-1346 |
| U58 | 5'→3' direction | 95048 to 97366 | amino acid 1-773 |
| U59 | 5'→3' direction | 97375 to 98415 | amino acid 1-347 |
| U60 | 3'→5' direction | 98412 to 99380 | amino acid 1-323 |
| U61 | 3'→5' direction | 99355 to 99867 | amino acid 1-171 |
| U62 | 5'→3' direction | 99551 to 99814 | amino acid 1-88 |
| U63 | 5'→3' direction | 99756 to 100412 | amino acid 1-219 |
| U64 | 5'→3' direction | 100390 to 101718 | amino acid 1-443 |
| U65 | 5'→3' direction | 101675 to 102682 | amino acid 1-336 |
| U66 | 3'→5' direction | 102702 to 103619 | amino acid 1-306 |
| U67 | 3'→5' direction | 103591 to 104652 | amino acid 1-354 |
| U68 | 5'→3' direction | 104652 to 104996 | amino acid 1-115 |
| U69 | 5'→3' direction | 104999 to 106690 | amino acid 1-564 |
| U70 | 5'→3' direction | 106698 to 108164 | amino acid 1-489 |
| U71 | 5'→3' direction | 108101 to 108346 | amino acid 1-82 |
| U72 | 3'→5' direction | 108428 to 109462 | amino acid 1-345 |
| U73 | 5'→3' direction | 109475 to 111817 | amino acid 1-781 |
| U74 | 5'→3' direction | 111786 to 113774 | amino acid 1-663 |
| U75 | 3'→5' direction | 113379 to 113756 | amino acid 1-126 |
| U76 | 3'→5' direction | 114467 to 116455 | amino acid 1-663 |
| U77 | 5'→3' direction | 116250 to 118724 | amino acid 1-825 |
| U79 | 5'→3' direction | 121322 to 122359 | amino acid 1-346 |
| U80 | 5'→3' direction | 122640 to 122942 | amino acid 1-101 |
| U81 | 3'→5' direction | 122986 to 123753 | amino acid 1-256 |
| U82 | 3'→5' direction | 123829 to 124581 | amino acid 1-251 |
| U83 | 5'→3' direction | 124657 to 124998 | amino acid 1-114 |
| U84 | 3'→5' direction | 125104 to 126132 | amino acid 1-343 |
| U85 | 3'→5' direction | 126160 to 127038 | amino acid 1-293 |
| U86 | 3'→5' direction | 127176 to 131717 | amino acid 1-1514 |
| U89 | 3'→5' direction | 134808 to 137684 | amino acid 1-959 |
| U90 | 3'→5' direction | 137810 to 138085 | amino acid 1-92 |
| U91 | 5'→3' direction | 138630 to 138974 | amino acid 1-115 |
| HN1 | 3'→5' direction | 141543 to 142355 | amino acid 1-271 |
| U94 | 3'→5' direction | 142683 to 144155 | amino acid 1-491 |
| U95 | 5'→3' direction | 144230 to 147868 | amino acid 1-1213 |
| U97 | 3'→5' direction | 149352 to 149651 | amino acid 1-100 |
| HN2 | 3'→5' direction | 149749 to 149913 | amino acid 1-55 |
| U98 | 3'→5' direction | 150376 to 150870 | amino acid 1-165 |
| U99 | 3'→5' direction | 151115 to 151396 | amino acid 1-94 |
| U100 | 3'→5' direction | 151529 to 151918 | amino acid 1-130 |
| RJ1 | 3'→5' direction | 153060 to 153407 | amino acid 1-116 |
| DR1R | 5'→3' direction | 153618 to 153884 | amino acid 1-89 |
| DR2R | 5'→3' direction | 154069 to 156012 | amino acid 1-648 |
| DR3R | 3'→5' direction | 155760 to 156362 | amino acid 1-201 |
| DRHN1R | 3'→5' direction | 158065 to 158574 | amino acid 1-170 |
| DR6R | 5'→3' direction | 158067 to 158378 | amino acid 1-104 |
| DR7R | 5'→3' direction | 159554 to 160192 | amino acid 1-213 |
| DRHN2R | 3'→5' direction | 160278 to 160748 | amino acid 1-157. |

In the above-described table, "5'→3' direction" indicates that the ORF has the same direction as that of the nucleic acid sequence of SEQ ID NO.: 272. "3'→5' direction" indicates that the ORF has a reverse direction with respect to that of the nucleic acid sequence of SEQ ID NO.: 272. By identifying a sequence homologous to the nucleic acid sequence and/or the amino acid sequence of the ORF, those skilled in the art can easily identify the ORF in the genome of a strain other than strain HST.

(Proteins Coded ORF's of HHV-6A and HHV-6B)

Features of a gene product coded by each ORF in the HHV-6A and HHV-6B genome are described in Tables 4 to 6 below. In the tables, the amino acid residue length of each ORF in strain U1102 of HHV-6A and strain HST of HHV-6B is indicated.

TABLE 4

Non-essential gene of HHV-6

| ORF | Amino acid residue length U1102/HST | Features |
|---|---|---|
| LT1 | 112/115 | |
| DR1 | 97/88 | US22 gene family |
| DR2 | 620/647 | US22 gene family |
| DR3 | 192/200 | |
| DR4 | 100/__ | |
| DR5 | 145/__ | |
| DR6 | 103/103 | US22 gene family |
| DRHN1 | __/169 | |
| DR7 | 363/212 | US22 gene family, transcription activating agent |
| DRHN2 | __/156 | |
| DR8 | 110/244 | |
| LJ1 | 321/172 | |
| U1 | 123/151 | |
| U2 | 366/433 | US22 gene family |
| U3 | 373/386 | US22 gene family |
| U4 | 535/535 | |
| U5 | 444/443 | |
| U6 | 82/85 | |
| U7 | 342/374 | US22 gene family |
| U8 | 356/411 | US22 gene family |

TABLE 4-continued

Non-essential gene of HHV-6

| ORF | Amino acid residue length U1102/HST | Features |
|---|---|---|
| U9 | 104/104 | |
| U10 | 436/503 | |
| U12EX | 347/353 | U12 exon 1 |
| U12 | 318/305 | U12 exon 2, CC-chemokine receptor |
| U13 | 106/107 | |
| U15 | 110/110 | |
| U16 | 143/143 | IE-B, transcription activating agent, US22 gene family |
| U17 | 133/86 | IE-B |
| U18 | 293/294 | homologous to IE-B, HCMV IE glycoprotein |
| U19 | 389/389 | IE-B |
| U20 | 422/434 | glycoprotein, Ig-chain C domain |
| U21 | 433/500 | glycoprotein |
| U22 | 202/202 | glycoprotein |
| U23 | 236/299 | glycoprotein |
| U24 | 87/88 | |
| U25 | 316/316 | US22 gene family, transcription activating agent |
| U26 | 295/295 | |
| U28 | 804/804 | ribonucleotide reductase (large subunit) |
| U32 | 88/89 | |
| U33 | 470/470 | capsid protein |
| U34 | 276/276 | possible virion protein |
| U35 | 106/106 | |
| U36 | 484/481 | possible virion protein |
| U37 | 264/264 | |
| U40 | 726/726 | transport protein |
| U42 | 514/516 | transcription activating agent |
| U44 | 213/231 | |
| U45 | 376/376 | dUTPase |
| U46 | 84/84 | |
| U47 | 651/738 | |
| U49 | 252/252 | fusion protein |
| U50 | 555/555 | virion protein |
| U51 | 301/301 | GCR, homolog of opioid |
| U52 | 258/258 | |
| U55 | 432/492 | |
| U58 | 772/772 | |
| U59 | 350/350 | |
| U61 | 115/170 | |
| U62 | 85/87 | |
| U63 | 216/218 | |
| U64 | 442/442 | |
| U65 | 335/335 | |
| U67 | 353/353 | |
| U68 | 114/114 | |
| U69 | 562/563 | Ganciclovir kinase, conserved phosphotransferase |
| U70 | 488/488 | alkali exonuclease |
| U71 | 77/81 | |
| U75 | 249/249 | |
| U76 | 662/662 | |
| U78 | 109/_ | |
| U79 | 344/345 | HCMV replication, spliced (UL112/113) |
| U80 | 198/203 | HCMV replication, spliced (UL112/113) |
| U81 | 255/255 | uracil - DNA glycosylase |
| U83 | 97/113 | chemokine |
| U84 | 342/342 | spliced in HCMV |
| U85 | 290/292 | homologous to OX-2 glycoprotein |
| U88 | 413/_ | |
| U91 | 114/114 | |
| U92 | 147/_ | |
| U93 | 197/_ | |
| HN2 | _/270 | |
| U94 | 490/490 | provirus replication, transcription activation |

TABLE 4-continued

Non-essential gene of HHV-6

| ORF | Amino acid residue length U1102/HST | Features |
|---|---|---|
| U95 | 1,121/1,197 | MCMV IE2 homolog, US22 gene family |
| U96 | 99/_ | |

TABLE 5

HHV-6 genes involved in viral replication

| ORF | Amino acid residue length U1102/HST | Features |
|---|---|---|
| U27 | 393/391 | DNA polymerase promoting agent |
| U38 | 1,012/1,012 | DNA polymerase |
| U41 | 1,132/1,132 | single stranded DNA - binding protein |
| U43 | 860/860 | helicase/primase complex |
| U73 | 780/780 | origin binding protein (OBP) |
| U74 | 662/662 | helicase/primase complex |
| U77 | 824/824 | helicase/primase complex |
| U86 | 1,351/1,513 | homology to IE-A, HCMV IE2 |
| U89 | 839/958 | IE-A, transcription activating agent |
| U90 | 94/89 | exon in IE-A |
| HN1 | _/32 | exon in IE-A |

TABLE 6

HHV-6 genes involved in formation of viral particle

| ORF | Amino acid residue length U1102/HST | Features |
|---|---|---|
| U11 | 870/858 | pp100, major antigenic structural protein |
| U14 | 609/610 | HCMV UL25/35 gene family |
| U29 | 299/299 | minor capsid protein (mCP) |
| U30 | 1,082/1,082 | capsid assembly, myosin (agent involved in association and formation of capsid (part of viral particle) |
| U31 | 2,077/2,077 | large tegument protein |
| U39 | 830/830 | glycoprotein B (gB) |
| U48 | 694/694 | glycoprotein H (gH) |
| U53 | 528/528 | protease/assembly protein |
| U54 | 458/459 | tegument protein, transcription activating agent |
| U56 | 296/296 | capsid protein |
| U57 | 1,345/1,345 | major capsid protein (MCP) |
| U60 | 322/322 | spliced in later phase (U60/66) protein involved in DNA packaging |
| U66 | 305/305 | spliced in later phase (U60/66) protein involved in DNA packaging |
| U72 | 344/344 | intramembranous protein (gM) |
| U82 | 250/250 | glycoprotein L (gL) |
| U97 | 89/99 | glycoprotein Q (gQ) exon |
| HN3 | _/55 | gQ exon |
| U98 | 216/164 | gQ exon |
| U99 | 93/93 | gQ exon |
| U100 | 189/129 | gQ exon |

When a gene in a viral genome is an essential gene, the virus cannot grow in the absence of the gene. Therefore, by deleting an arbitrary gene in a viral genome and detecting the growth of the virus, it is possible to determine whether the gene is an essential gene or a non-essential gene.

As used herein, the term "wild strain" in relation to herpesvirus refers to a herpesvirus strain which is not artificially modified and is isolated from the nature.

As used herein, the term "mutant strain" refers to a herpesvirus strain which has a mutation due to mutagenesis, multiple subculturings or the like. Mutagenesis of a herpesvirus strain may be either random mutagenesis or site-specific mutagenesis.

The terms "protein", "polypeptide", "oligopeptide" and "peptide" as used herein have the same meaning and refer to an amino acid polymer having any length.

The terms "polynucleotide", "oligonucleotide", and "nucleic acid" as used herein have the same meaning and refer to a nucleotide polymer having any length. Unless otherwise indicated, a particular nucleic acid sequence also implicitly encompasses conservatively-modified variants thereof (e.g. degenerate codon substitutions) and complementary sequences as well as the sequence explicitly indicated. Specifically, degenerate codon substitutions may be produced by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); Rossolini et al., Mol. Cell. Probes 8:91-98 (1994)).

As used herein, the term "gene" refers to an element defining a genetic trait. A gene is typically arranged in a given sequence on a chromosome. A gene which defines the primary structure of a protein is called a structural gene. A gene which regulates the expression of a structural gene is called a regulatory gene. As used herein, "gene" may refer to "polynucleotide", "oligonucleotide", "nucleic acid", and "nucleic acid molecule" and/or "protein", "polypeptide", "oligopeptide" and "peptide". As used herein, the term "open reading frame" or "ORF" in relation to a gene, refers to a reading frame which is one of three frames obtained by sectioning the base sequence of a gene at intervals of three bases, and has a start codon and a certain length without a stop codon appearing partway, and has the possibility of actually coding a protein. The entire base sequence of the genome of herpesvirus has been determined, identifying at least 101 genes. Each of the genes is known to have an open reading frame (ORF).

As used herein, the term "region within an ORF" in relation to a gene in a herpesvirus genome, refers to a region in which there are bases constituting the ORF in the gene within the herpesvirus genome.

As used herein, the term "region flanking an ORF" in relation to a gene in a herpesvirus genome, refers to a region in which there are bases existing in the vicinity of the ORF in the gene within the herpesvirus genome, and which does not correspond to a region within the ORF of the gene or other genes.

As used herein, the term "homology" of a gene refers to the proportion of identity between two or more gene sequences. Therefore, the greater the homology between two given genes, the greater the identity or similarity between their sequences. Whether or not two genes have homology is determined by comparing their sequences directly or by a hybridization method under stringent conditions. When two gene sequences are directly compared with each other, these genes have homology if the DNA sequences of the genes have representatively at least 50% identity, preferably at least 70% identity, more preferably at least 80%, 90%, 95%, 96%, 97%, 98%, or 99% identity with each other.

Similarity comparison and homology calculation of base sequences are herein performed using BLAST (sequence analyzing tool) with the default parameters.

As used herein, the term "expression" of a gene, a polynucleotide, a polypeptide, or the like, indicates that the gene or the like is affected by a predetermined action in vivo to be changed into another form. Preferably, the term "expression" indicates that genes, polynucleotides, or the like are transcribed and translated into polypeptides. In one embodiment of the present invention, genes may be transcribed into mRNA. More preferably, these polypeptides may have post-translational processing modifications.

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

As used herein, the term "fragment" refers to a polypeptide or polynucleotide having a sequence length ranging from 1 to n−1 with respect to the full length of the reference polypeptide or polynucleotide (of length n). The length of the fragment can be appropriately changed depending on the purpose. For example, in the case of polypeptides, the lower limit of the length of the fragment includes 3, 4, 5, 6, 7, 8, 9, 10, 15, 20, 25, 30, 40, 50 or more nucleotides. Lengths represented by integers which are not herein specified (e.g., 11 and the like) may be appropriate as a lower limit. For example, in the case of polynucleotides, the lower limit of the length of the fragment includes 5, 6, 7, 8, 9, 10, 15, 20, 25, 30, 40, 50, 75, 100 or more nucleotides. Lengths represented by integers which are not herein specified (e.g., 11 and the like) may be appropriate as a lower limit.

A polypeptide encoded by a gene in a BAC vector may have at least one (e.g., one or several) amino acid substitution, addition, and/or deletion or at least one sugar chain substitution, addition, and/or deletion as long as they have substantially the same function as that of a corresponding naturally-occurring polypeptide.

As used herein, the term "sugar chain" refers to a compound which is made up of a series of at least one sugar unit (a monosaccharide and/or its derivative). When two or more sugars unit are linked, the sugars unit are joined by dehydro-condensation due to glycosidic bonds. Examples of such a sugar chain include, but are not limited to, polysaccharides contained in organisms (glucose, galactose, mannose, fucose, xylose, N-acetylglucosamine, N-acetylgalactosamine, sialic acid, and complexes and derivates thereof), and degraded polysaccharides, sugar chains degraded or induced from complex biological molecules (e.g., glycoproteins, proteoglycan, glycosaminoglycan, glycolipids, etc.), and the like. Therefore, the term "sugar chain" may be herein used interchangeably with "polysaccharide", "carbohydrate", and "hydrocarbon". Unless otherwise specified, the term "sugar chain" as used herein includes both a sugar chain and a sugar chain-containing substance.

It is well known that if a given amino acid is substituted with another amino acid having a similar hydrophobicity index, the resultant protein may still have a biological function similar to that of the original protein (e.g., a protein having an equivalent enzymatic activity). For such an amino acid substitution, the hydrophobicity index is preferably within ±2, more preferably within ±1, and even more preferably within ±0.5. It is understood in the art that such an amino acid substitution based on hydrophobicity is efficient. A hydrophilicity index is also useful for modification of an amino acid sequence of the present invention. As described in U.S. Pat. No. 4,554,101, amino acid residues are given the following hydrophilicity indices: arginine (+3.0); lysine (+3.0); aspartic acid (+3.0±1); glutamic acid (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); and tryptophan (−3.4). It is understood that an amino acid may be substituted with another amino acid which has a similar hydrophilicity index and can still provide a biological equivalent. For such an amino acid substitution, the hydrophilicity index is preferably within ±2, more preferably ±1, and even more preferably ±0.5.

The term "conservative substitution" as used herein refers to amino acid substitution in which a substituted amino acid and a substituting amino acid have similar hydrophilicity indices or/and hydrophobicity indices. For example, conservative substitution is carried out between amino acids having a hydrophilicity or hydrophobicity index of within ±2, preferably within ±1, and more preferably within ±0.5. Examples of conservative substitution include, but are not limited to, substitutions within each of the following residue pairs: arginine and lysine; glutamic acid and aspartic acid; serine and threonine; glutamine and asparagine; and valine, leucine, and isoleucine, which are well known to those skilled in the art.

As used herein, the term "variant" refers to a substance, such as a polypeptide, polynucleotide, or the like, which differs partially from the original substance. Examples of such a variant include a substitution variant, an addition variant, a deletion variant, a truncated variant, an allelic variant, and the like. Examples of such a variant include, but are not limited to, a nucleotide or polypeptide having one or several substitutions, additions and/or deletions or a nucleotide or polypeptide having at least one substitution, addition and/or deletion. The term "allele" as used herein refers to a genetic variant located at a locus identical to a corresponding gene, where the two genes are distinguished from each other. Therefore, the term "allelic variant" as used herein refers to a variant which has an allelic relationship with a given gene. Such an allelic variant ordinarily has a sequence the same as or highly similar to that of the corresponding allele, and ordinarily has almost the same biological activity, though it rarely has different biological activity. The term "species homolog" or "homolog" as used herein refers to one that has an amino acid or nucleotide homology with a given gene in a given species (preferably at least 60% homology, more preferably at least 80%, at least 85%, at least 90%, and at least 95% homology). A method for obtaining such a species homolog is clearly understood from the description of the present specification. The term "ortholog" (also called orthologous genes) refers to genes in different species derived from a common ancestry (due to speciation). For example, in the case of the hemoglobin gene family having multigene structure, human and mouse α-hemoglobin genes are orthologs, while the human α-hemoglobin gene and the human β-hemoglobin gene are paralogs (genes arising from gene duplication). Orthologs are useful for estimation of molecular phylogenetic trees. Usually, orthologs in different species may have a function similar to that of the original species. Therefore, orthologs of the present invention may be useful in the present invention.

As used herein, the term "conservative (or conservatively modified) variant" applies to both amino acid and nucleic acid sequences. With respect to particular nucleic acid sequences, conservatively modified variants refer to those nucleic acids which encode identical or essentially identical amino acid sequences. Because of the degeneracy of the genetic code, a large number of functionally identical nucleic acids encode any given protein. For example, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations" which represent one species of conservatively modified variation. Every nucleic acid sequence herein which encodes a polypeptide also describes every possible silent variation of the nucleic acid. Those skilled in the art will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid which encodes a polypeptide is implicit in each described sequence. Preferably, such modification may be performed while avoiding substitution of cysteine which is an amino acid capable of largely affecting the higher-order structure of a polypeptide. Examples of a method for such modification of a base sequence include cleavage using a restriction enzyme or the like; ligation or the like by treatment using DNA polymerase, Klenow fragments, DNA ligase, or the like; and a site specific base substitution method using synthesized oligonucleotides (specific-site directed mutagenesis; Mark Zoller and Michael Smith, Methods in Enzymology, 100, 468-500 (1983)). Modification can be performed using methods ordinarily used in the field of molecular biology.

In order to prepare a BAC vector containing a gene encoding a functionally equivalent polypeptide, amino acid additions, deletions, or modifications can be performed in addition to amino acid substitutions. Amino acid substitution(s) refers to the replacement of at least one amino acid of an original peptide chain with different amino acids, such as the replacement of 1 to 10 amino acids, preferably 1 to 5 amino acids, and more preferably 1 to 3 amino acids with different amino acids. Amino acid addition(s) refers to the addition of at least one amino acid to an original peptide chain, such as the addition of 1 to 10 amino acids, preferably 1 to 5 amino acids, and more preferably 1 to 3 amino acids to an original peptide chain. Amino acid deletion(s) refers to the deletion of at least one amino acid, such as the deletion of 1 to 10 amino acids, preferably 1 to 5 amino acids, and more preferably 1 to 3 amino acids. Amino acid modification includes, but is not limited to, amidation, carboxylation, sulfation, halogenation, truncation, lipidation, alkylation, glycosylation, phosphorylation, hydroxylation, acylation (e.g., acetylation), and the like. Amino acids to be substituted or added may be naturally-occurring or nonnaturally-occurring amino acids, or amino acid analogs. Naturally-occurring amino acids are preferable.

As used herein, a nucleic acid form of a polypeptide refers to a nucleic acid molecule capable of expressing a protein form of the polypeptide. This nucleic acid molecule may have a nucleic acid sequence, a part of which is deleted or substituted with another base, or alternatively, into which another nucleic acid sequence is inserted, as long as an expressed polypeptide has substantially the same activity as that of a naturally occurring polypeptide. Alternatively, another nucleic acid may be linked to the 5' end and/or the 3' end of the nucleic acid molecule. The nucleic acid molecule may be a nucleic acid molecule which is hybridizable to a gene encoding a polypeptide under stringent conditions and encodes a polypeptide having substantially the same function as that polypeptide. Such a gene is known in the art and is available in the present invention.

Such a nucleic acid can be obtained by a well known PCR technique, or alternatively, can be chemically synthesized. These methods may be combined with, for example, site-specific mutagenesis, hybridization, or the like.

As used herein, the term "substitution, addition or deletion" for a polypeptide or a polynucleotide refers to the substitution, addition or deletion of an amino acid or its substitute, or a nucleotide or its substitute, with respect to the original polypeptide or polynucleotide, respectively. This is achieved by techniques well known in the art, including a site-specific mutagenesis technique and the like. A polypeptide or a polynucleotide may have any number (>0) of substitutions, additions, or deletions. The number can be as large as a variant having such a number of substitutions, additions or deletions which maintains an intended function. For example, such a number may be one or several, and preferably within 20% or 10% of the full length, or no more than 100, no more than 50, no more than 25, or the like.

The structure of polymers (e.g., polypeptide structure) may be described at various levels. This structure is generally described in, for example, Alberts et al., Molecular Biology of the Cell (3rd Ed., 1994), and Cantor and Schimmel, Biophysical Chemistry Part I: The Conformation of Biological Macromolecules (1980). General molecular biological techniques available in the present invention can be easily carried out by the those skilled in the art by referencing Ausubel F. A. et al. eds. (1988), Current Protocols in Molecular Biology, Wiley, New York, N.Y.; Sambrook J. et al., (1987) Molecular Cloning: A Laboratory Manual, 2nd Ed., Cold Spring Harbor Laboratory Press, Cold Spring Harbor, N.Y., or the like.

When mentioning genes in the present specification, "vector" refers to an agent which can transfer a polynucleotide sequence of interest to a target cell. Examples of such a vector include vectors which are capable of self replication or capable of being incorporated into a chromosome within host cells (e.g., prokaryotic cells, yeast, animal cells, plant cells, insect cells, whole animals, and whole plants), and contain a promoter at a site suitable for transcription of a polynucleotide of the present invention.

The term "BAC vector" refers to a plasmid which is produced using F plasmid of E. coli and a vector which can stably maintain and grow a large size DNA fragment of about 300 kb or more in bacteria, such as E. coli and the like. The BAC vector contains at least a region essential for the replication of the BAC vector. Examples of such a region essential for replication include, but are not limited to, the replication origin of F plasmid (oriS) and variants thereof.

As used herein, the term "BAC vector sequence" refers to a sequence comprising a sequence essential for the function of a BAC vector. Optionally, the BAC vector sequence may further comprise a "recombinant protein-dependent recombinant sequence" and/or a "selectable marker".

As used herein, the term "recombinant" in relation to nucleic acid is used interchangeably with the term "homologous recombination", and indicates that two different homologous nucleic acid molecules encounter each other, crossover occurs, and a new combination of nucleic acid is generated. As used herein, homologous recombination includes both "recombinant protein-dependent recombination" and "recombinant protein-independent recombination". The term "recombinant protein-dependent recombination" refers to homologous recombination which occurs in the presence of a recombinant protein, but not in the absence of a recombinant protein. The term "recombinant protein-independent recombination" refers to homologous recombination which occurs irrespective of the presence or absence of a recombinant protein. As used herein, the term "recombinant protein-dependent recombinant sequence" refers to a sequence which causes recombinant protein-dependent recombination. The term "recombinant protein-independent recombinant sequence" refers to a sequence which causes recombinant protein-independent recombination. The recombinant protein-dependent recombinant sequence causes recombination in the presence of a recombinant protein, but not in the absence of a recombinant protein. A recombinant protein preferably acts specifically on a recombinant protein-dependent recombinant sequence, and does not act on sequences other than the recombinant protein-dependent recombinant sequence.

Examples of representative pairs of a recombinant protein-dependent recombinant sequence and a recombinant protein include, but are not limited to: a combination of a bacteriophage P1-derived loxP (locus of crossover of P1) sequence and a Cre (cyclization recombination) protein, a combination of Flp protein and FRT site, a combination of φC31 and attB or attP (Thorpe, Helena M.; Wilson, Stuart E.; Smith, Margaret C. M., Control of directionality in the site-specific recombination system of the *Streptomyces* phage φC31., Molecular Microbiology (2000), 38(2), 232-241.), a combination of resolvase and res site (Sadowski P., Site-specific recombinases: changing partners and doing the twist, J. Bacteriol., February 1986; 165(2) 341-7) (generally, Sauer B., Site-specific recombination: developments and applications., Curr. Opin. Biotechnol., 1994 Oct.; 5(5): 521-7).

As used herein, the term "selectable marker" refers to a gene which functions as an index for selection of a host cell containing a BAC vector. Examples of a selectable marker include, but are not limited to, fluorescent markers, luminescent markers, and drug selectable markers. An example of a "fluorescent marker" is, but is not limited to, a gene encoding a fluorescent protein, such as a green fluorescent protein (GFP). An example of a "luminescent marker" is, but is not limited to, a gene encoding a luminescent protein, such as luciferase. An example of a "drug selectable marker" is, but is not limited to, a gene encoding a protein selected from the group consisting of: dihydrofolate reductase gene, glutamine synthase gene, aspartic acid transaminase, metallothionein (MT), adenosine deaminase (ADA), adenosine deaminase (AMPD1, 2), xanthine-guanine-phosphoribosyl transferase, UMP synthase, P-glycoprotein, asparagine synthase, and ornithine decarboxylase. Examples of a combination of a drug selectable marker and a drug include: a combination of dihydrofolate reductase gene (DHFR) and methotrexate (MTX), a combination of glutamine synthase (GS) gene and methionine sulfoximine (Msx), a combination of aspartic acid transaminase (AST) gene and N-phosphonacetyl-L-aspartate) (PALA), a combination of MT gene and cadmium ($Cd^{2+}$), a combination of adenosine deaminase (ADA) gene and adenosine, alanosine, or 2'-deoxycoformycin, a combination of adenosine deaminase (AMPD1, 2) gene and adenine, azaserine, or coformycin, a combination of xanthine-guanine-phosphoribosyltransferase gene and mycophenolic acid, a combination of UMP synthase gene and 6-azaulysine or pyrazofuran, a combination of P-glycoprotein (P-gp, MDR) gene and multiple drugs, a combination of asparagine synthase (AS) gene and β-aspartyl hydroxamic acid or albizziin, and a combination of ornithine decarboxylase (ODC) gene and β-difluoromethyl-ornithine (DFMO).

As used herein, the term "expression vector" refers to a nucleic acid sequence comprising a structural gene and a promoter for regulating expression thereof, and in addition, various regulatory elements in a state that allows them to operate within host cells. The regulatory element may include, preferably, terminators, selectable markers such as drug-resistance genes (e.g., a kanamycin resistance gene, a hygromycin resistance gene, etc.), and enhancers. It is well known to those skilled in the art that the type of an organism (e.g., a plant) expression vector and the type of a regulatory element may vary depending on the host cell. In the case of plants, a plant expression vector for use in the present invention may further has a T-DNA region. A T-DNA region enhances the efficiency of gene transfer, especially when a plant is transformed using *Agrobacterium*.

As used herein, the term "recombinant vector" refers to a vector which can transfer a polynucleotide sequence of interest to a target cell. Examples of such a vector include vectors which are capable of self replication or capable of being incorporated into a chromosome within host cells (e.g., prokaryotic cells, yeast, animal cells, plant cells, insect cells, whole animals, and whole plants), and contain a promoter at a site suitable for transcription of a polynucleotide of the present invention.

As used herein, the term "terminator" refers to a sequence which is located downstream of a protein-encoding region of a gene and which is involved in the termination of transcription when DNA is transcribed into mRNA, and the addition of a poly A sequence. It is known that a terminator contributes to the stability of mRNA, and has an influence on the amount of gene expression. Examples of a terminator include, but are not limited to, terminators derived from mammals, the CaMV35S terminator, the terminator of the nopaline synthase gene (Tnos), the terminator of the tobacco PR1a gene, and the like.

As used herein, the term "promoter" refers to a base sequence which determines the initiation site of transcription of a gene and is a DNA region which directly regulates the frequency of transcription. Transcription is started by RNA polymerase binding to a promoter. A promoter region is usually located within about 2 kbp upstream of the first exon of a putative protein coding region. Therefore, it is possible to estimate a promoter region by predicting a protein coding region in a genomic base sequence using DNA analysis software. A putative promoter region is usually located upstream of a structural gene, but depending on the structural gene, i.e., a putative promoter region may be located downstream of a structural gene. Preferably, a putative promoter region is located within about 2 kbp upstream of the translation initiation site of the first exon.

As used herein, the term "constitutive" for expression of a promoter of the present invention refers to a character of the promoter that the promoter is expressed in a substantially constant amount in all tissues of an organism no matter whether the growth stage of the organism is a juvenile phase or a mature phase. Specifically, when Northern blotting analysis is performed under the same conditions as those described in examples of the present specification, expression is considered to be constitutive according to the definition of the present invention if substantially the same amount of expression is observed at the same or corresponding site at any time (e.g., two or more time points (e.g., day 5 and day 15)), for example. Constitutive promoters are considered to play a role in maintaining the homeostasis of organisms in a normal growth environment. These characters can be determined by extracting RNA from any portion of an organism and analyzing the expression amount of the RNA by Northern blotting or quantitating expressed proteins by Western blotting.

An "enhancer" may be used so as to enhance the expression efficiency of a gene of interest. When used in animals, an enhancer region containing an upstream sequence within the SV40 promoter is preferable. One or more enhancers may be used, or no enhancer may be used.

As used herein, the term "operatively linked" indicates that a desired sequence is located such that expression (operation) thereof is under control of a transcription and translation regulatory sequence (e.g., a promoter, an enhancer, and the like) or a translation regulatory sequence. In order for a promoter to be operatively linked to a gene, typically, the promoter is located immediately upstream of the gene. A promoter is not necessarily adjacent to a structural gene.

As used herein, the terms "transformation", "transduction" and "transfection" are used interchangeably unless otherwise mentioned, and refers to introduction of a nucleic acid into host cells. As a transformation method, any technique for introducing DNA into host cells can be used, including various well-known techniques, such as, for example, the electroporation method, the particle gun method (gene gun), the calcium phosphate method, and the like.

As used herein, the term "transformant" refers to the whole or a part of an organism, such as a cell, which is produced by transformation. Examples of a transformant include prokaryotic cells, yeast, animal cells, plant cells, insect cells and the like. Transformants may be referred to as transformed cells, transformed tissue, transformed hosts, or the like, depending on the subject. As used herein, all of the forms are encompassed, however, a particular form may be specified in a particular context.

Examples of prokaryotic cells include prokaryotic cells of the genera *Escherichia, Serratia, Bacillus, Brevibacterium, Corynebacterium, Microbacterium, Pseudomonas*, and the like, e.g., *Escherichia coli* XL1-Blue, *Escherichia coli* XL2-Blue, *Escherichia coli* DH1, *Escherichia coli* MC1000, *Escherichia coli* KY3276, *Escherichia coli* W1485, *Escherichia coli* JM109, *Escherichia coli* HB101, *Escherichia coli* No. 49, *Escherichia coli* W3110, *Escherichia coli* NY49, *Escherichia coli* BL21 (DE3), *Escherichia coli* BL21 (DE3) pLysS, *Escherichia coli* HMS174(DE3), *Escherichia coli* HMS174(DE3)pLysS, *Serratia ficaria, Serratia fonticola, Serratia liquefaciens, Serratia marcescens, Bacillus subtilis, Bacillus amyloliquefaciens, Brevibacterium ammmoniagenes, Brevibacterium immariophilum* ATCC14068, *Brevibacterium* saccharolyticum ATCC14066, *Corynebacterium glutamicum* ATCC13032, *Corynebacterium glutamicum* ATCC14067, *Corynebacterium glutamicum* ATCC13869, *Corynebacterium acetoacidophilum* ATCC13870, *Microbacterium ammoniaphilum* ATCC15354, *Pseudomonas* sp.D-0110, and the like.

Examples of animal cells include cord blood mononuclear cells, peripheral blood mononuclear cells, Sup-T1 cells, and the like.

The term "animal" is used herein in its broadest sense and refers to vertebrates and invertebrates (e.g., arthropods). Examples of animals include, but are not limited to, any of the class Mammalia, the class Aves, the class Reptilia, the class Amphibia, the class Pisces, the class Insecta, the class Vermes, and the like.

As used herein, the term "tissue" in relation to organisms refers to an aggregate of cells having substantially the same function. Therefore, a tissue may be a part of an organ. Organs usually have cells having the same function, and may have coexisting cells having slightly different functions. Therefore, as used herein, tissues may have various kinds of cells as long as a certain property is shared by the cells.

As used herein, the term "organ" refers to a structure which has a single independent form and in which one or more tissues are associated together to perform a specific function. In plants, examples of organs include, but are not limited to, callus, root, stem, trunk, leaf, flower, seed, embryo bud, embryo, fruit, and the like. In animals, examples of organs include, but are not limited to, stomach, liver, intestine, pancreas, lung, airway, nose, heart, artery, vein, lymph node (lymphatic system), thymus, ovary, eye, ear, tongue, skin, and the like.

As used herein, the term "transgenic" refers to incorporation of a specific gene into an organism (e.g., plants or animals (mice, etc.)) or such an organism having an incorporated gene.

When organisms of the present invention are animals, the transgenic organisms can be produced by a microinjection method (a trace amount injection method), a viral vector method, an embryonic stem (ES) cell method, a sperm vector method, a chromosome fragment introducing method (transsomic method), an episome method, or the like. These transgenic animal producing techniques are well known in the art.

As used herein, the term "screening" refers to selection of a substance, a host cell, a virus, or the like having a given specific property of interest from a number of candidates using a specific operation/evaluation method. It will be understood that the present invention encompasses viruses having desired activity obtained by screening.

As used herein, the terms "chip" or "microchip" are used interchangeably to refer to a micro integrated circuit which has versatile functions and constitutes a portion of a system. Examples of a chip include, but are not limited to, DNA chips, protein chips, and the like.

As used herein, the term "array" refers to a substrate (e.g., a chip, etc.) which has a pattern of a composition containing at least one (e.g., 1000 or more, etc.) target substances (e.g., DNA, proteins, transfection mixtures, etc.), which are arrayed. Among arrays, patterned substrates having a small size (e.g., 10×10 mm, etc.) are particularly referred to as microarrays. The terms "microarray" and "array" are used interchangeably. Therefore, a patterned substrate having a larger size than that which is described above may be referred to as a microarray. For example, an array comprises a set of desired transfection mixtures fixed to a solid phase surface or a film thereof. An array preferably comprises at least $10^2$ antibodies of the same or different types, more preferably at least $10^3$, even more preferably at least $10^4$, and still even more preferably at least $10^5$. These antibodies are placed on a surface of up to 125×80 mm, more preferably 10×10 mm. An array includes, but is not limited to, a 96-well microtiter plate, a 384-well microtiter plate, a microtiter plate the size of a glass slide, and the like. A composition to be fixed may contain one or a plurality of types of target substances. Such a number of target substance types may be in the range of from one to the number of spots, including, without limitation, about 10, about 100, about 500, and about 1,000.

As described above, any number of target substances (e.g., proteins, such as antibodies) may be provided on a solid phase surface or film, typically including no more than $10^8$ biological molecules per substrate, in another embodiment no more than $10^7$ biological molecules, no more than $10^6$ biological molecules, no more than $10^5$ biological molecules, no more than $10^4$ biological molecules, no more than $10^3$ biological molecules, or no more than $10^2$ biological molecules. A composition containing more than $10^8$ biological molecule target substances may be provided on a substrate. In these cases, the size of a substrate is preferably small. Particularly, the size of a spot of a composition containing target substances (e.g., proteins such as antibodies) may be as small as the size of a single biological molecule (e.g., 1 to 2 nm order). In some cases, the minimum area of a substrate may be determined based on the number of biological molecules on a substrate.

"Spots" of biological molecules may be provided on an array. As used herein, the term "spot" refers to a certain set of compositions containing target substances. As used herein, the term "spotting" refers to an act of preparing a spot of a composition containing a certain target substance on a substrate or plate. Spotting may be performed by any method, for example, pipetting or the like, or alternatively, using an automatic device. These methods are well known in the art.

As used herein, the term "address" refers to a unique position on a substrate, which may be distinguished from other unique positions. Addresses are appropriately associated with spots. Addresses can have any distinguishable shape such that substances at each address may be distinguished from substances at other addresses (e.g., optically). A shape defining an address may be, for example, without limitation, a circle, an ellipse, a square, a rectangle, or an irregular shape. Therefore, the term "address" is used to indicate an abstract concept, while the term "spot" is used to indicate a specific concept. Unless it is necessary to distinguish them from each other, the terms "address" and "spot" may be herein used interchangeably.

The size of each address particularly depends on the size of the substrate, the number of addresses on the substrate, the amount of a composition containing target substances and/or available reagents, the size of microparticles, and the level of resolution required for any method used for the array. The size of each address may be, for example, in the range of from 1-2 nm to several centimeters, though the address may have any size suited to an array.

The spatial arrangement and shape which define an address are designed so that the microarray is suited to a particular application. Addresses may be densely arranged or sparsely distributed, or subgrouped into a desired pattern appropriate for a particular type of material to be analyzed.

As used herein, the term "support" refers to a material which can carry cells, bacteria, viruses, polynucleotides, or polypeptides. Such a support may be made from any solid material which has a capability of binding to a biological molecule as used herein via covalent or noncovalent bond, or which may be induced to have such a capability.

Examples of materials used for supports include any material capable of forming a solid surface, such as, without limitation, glass, silica, silicon, ceramics, silicon dioxide, plastics, metals (including alloys), naturally-occurring and synthetic polymers (e.g., polystyrene, cellulose, chitosan, dextran, and nylon), and the like. Preferably, a support comprises a portion for producing hydrophobic bonds. A support may be formed of layers made of a plurality of materials. For example, a support may be made of an inorganic insulating material, such as glass, quartz glass, alumina, sapphire, forsterite, silicon oxide, silicon carbide, silicon nitride, or the like. A support may be made of an organic material, such as polyethylene, ethylene, polypropylene, polyisobutylene, polyethylene terephthalate, unsaturated polyester, fluorine-containing resin, polyvinyl chloride, polyvinylidene chloride, polyvinyl acetate, polyvinyl alcohol, polyvinyl acetal, acrylic resin, polyacrylonitrile, polystyrene, acetal resin, polycarbonate, polyamide, phenol resin, urea resin, epoxy resin, melamine resin, styrene-acrylonitrile copolymer, acrylonitrile-butadiene-styrene copolymer, silicone resin, polyphenylene oxide, polysulfone, and the like. Alternatively, nitrocellulose film, nylon film, PVDF film, or the like, which are used in blotting, may be used as a material for a support.

The herpesvirus of the present invention can be used as an ingredient of a pharmaceutical composition for the treatment, prevention, and/or therapy of infectious diseases.

As used herein, the term "effective amount" in relation to a drug refers to an amount which causes the drug to exhibit intended efficacy. As used herein, an effective amount corresponding to a smallest concentration may be referred to as a minimum effective amount. Such a minimum effective amount is well known in the art. Typically, the minimum effective amount of a drug has been determined or can be determined as appropriate by those skilled in the art. The determination of such an effective amount can be achieved by actual administration, use of an animal model, or the like. The present invention is also useful for the determination of such an effective amount.

As used herein, the term "pharmaceutically acceptable carrier" refers to a material which is used for production of a pharmaceutical agent or an agricultural chemical (e.g., an animal drug), and has no adverse effect on effective ingredients. Examples of such a pharmaceutically acceptable carrier include, but are not limited to: antioxidants, preservatives, colorants, flavoring agents, diluents, emulsifiers, suspending agents, solvents, fillers, bulking agents, buffers, delivery vehicles, excipients, and/or agricultural or pharmaceutical adjuvants.

The type and amount of a pharmaceutical agent used in the treatment method of the present invention can be easily determined by those skilled in the art based on information obtained by the method of the present invention (e.g., information relating to a disease) in view of the purpose of use, the target disease (type, severity, etc.), the subject's age, size, sex, and case history, the morphology and type of a site of a subject of administration, or the like. The frequency of subjecting a subject (patient) to the monitoring method of the present invention is also easily determined by those skilled in the art with respect to the purpose of use, the target disease (type, severity, etc.), the subject's age, size, sex, and case history, the progression of the therapy, and the like. Examples of the frequency of monitoring the state of a disease include once per day to once per several months (e.g., once per week to once per month). Preferably, monitoring is performed once per week to once per month with reference to the progression.

As used herein, the term "instructions" refers to a description of the method of the present invention for a person who performs administration, such as a medical doctor, a patient, or the like. Instructions state when to administer a medicament of the present invention, such as immediately after or before radiation therapy (e.g., within 24 hours, etc.). The instructions are prepared in accordance with a format defined by an authority of a country in which the present invention is practiced (e.g., Health, Labor and Welfare Ministry in Japan, Food and Drug Administration (FDA) in the U.S., and the like), explicitly describing that the instructions are approved by the authority. The instructions are so-called package insert and are typically provided in paper media. The instructions are not so limited and may be provided in the form of electronic media (e.g., web sites, electronic mails, and the like provided on the Internet).

In a therapy of the present invention, two or more pharmaceutical agents may be used as required. When two or more pharmaceutical agents are used, these agents may have similar properties or may be derived from similar origins, or alternatively, may have different properties or may be derived from different origins. A method of the present invention can be used to obtain information about the drug resistance level of a method of administering two or more pharmaceutical agents.

In the present invention, it will be appreciated by those skilled in the art that once the analysis result of a certain sugar chain structure has been correlated with a level of a disease concerning a similar type of organism, culture cell, tissue, animal (e.g., a mouse for a human) or the like, a corresponding sugar chain structure can be correlated with the disease level. Such matters are described and supported in, for example, "Doubutsu Baiyosaibo Manuaru (Animal Culture Cell Manual), Seno et al. eds., Kyoritsu shuppan, 1993, the entirety of which is hereby incorporated by reference.

(General Techniques Used Herein)

Techniques used herein are within the technical scope of the present invention unless otherwise specified. These techniques are commonly used in the fields of sugar chain science, fluidics, micromachining, organic chemistry, biochemistry, genetic engineering, molecular biology, microbiology, genetics, and their relevant fields. The techniques are well described in documents described below and the documents mentioned herein elsewhere.

Micromachining is described in, for example, Campbell, S. A. (1996), The Science and Engineering of Microelectronic Fabrication, Oxford University Press; Zaut, P. V. (1996), Micromicroarray Fabrication: a Practical Guide to Semiconductor Processing, Semiconductor Services; Madou, M. J. (1997), Fundamentals of Microfabrication, CRC1 5 Press; Rai-Choudhury, P. (1997), Handbook of Microlithography, Micromachining & Microfabrication: Microlithography; and the like, the relevant portions of which are hereby incorporated by reference.

Molecular biology techniques, biochemistry techniques, and microbiology techniques used herein are well known and commonly used in the art, and are described in, for example, Maniatis, T. et al. (1989), Molecular Cloning: A Laboratory Manual, Cold Spring Harbor and its 3rd Ed. (2001); Ausubel, F. M. et al. eds, Current Protocols in Molecular Biology, John Wiley & Sons Inc., NY, 10158 (2000); Innis, M. A. (1990), PCR Protocols: A Guide to Methods and Applications, Academic Press; Innis, M. A. et al. (1995), PCR Strategies, Academic Press; Sninsky, J. J. et al. (1999), PCR Applications: Protocols for Functional Genomics, Academic Press; Gait, M. J. (1985), Oligonucleotide Synthesis: A Practical Approach, IRL Press; Gait, M. J. (1990), Oligonucleotide Synthesis: A Practical Approach, IRL Press; Eckstein, F. (1991), Oligonucleotides and Analogues: A Practical Approach, IRL Press; Adams, R. L. et al. (1992), The Biochemistry of the Nucleic Acids, Chapman & Hall; Shabarova, Z. et al. (1994), Advanced Organic Chemistry of Nucleic Acids, Weinheim; Blackburn, G. M. et al. (1996), Nucleic Acids in Chemistry and Biology, Oxford University Press; Hermanson, G. T. (1996), Bioconjugate Techniques, Academic Press; Method in Enzymology 230, 242, 247, Academic Press, 1994; Special issue, Jikken Igaku (Experimental Medicine) "Idenshi Donyu & Hatsugenkaiseki Jikkenho (Experimental Method for Gene introduction & Expression Analysis)", Yodo-sha, 1997; and the like. Relevant portions (or possibly the entirety) of each of these publications are herein incorporated by reference.

DESCRIPTION OF PREFERRED EMBODIMENTS

Hereinafter, the present invention will be described by way of embodiments. Embodiments described below are provided only for illustrative purposes. Accordingly, the scope of the present invention is not limited by the embodiments except as by the appended claims. It will be clearly appreciated by those skilled in the art that variations and modifications can be made without departing from the scope of the present invention with reference to the specification.

According to an aspect of the present invention, a recombinant herpesvirus is provided. Preferably, the herpesvirus contains a BAC vector sequence in its genome sequence. By constructing a herpesvirus genome containing a BAC vector sequence, it becomes possible to handle the herpesvirus genome as the BAC molecule in bacteria. A BAC vector sequence used herein preferably contains an origin of replication derived from F plasmid, or alternatively may contain any origin of replication other than an origin of replication derived from F plasmid, as long as it has a sequence of 300 kb or more and can be held and grown as a bacterial artificial sequence in bacterial cells. The BAC vector of the present invention can be maintained and/or grow in bacterial host cells, preferably *E. coli* cells. Preferably, a portion of the BAC vector is inserted into a non-essential region of a herpesvirus genome, so that it is possible to manipulate it as a BAC containing the herpesvirus genome. When the BAC containing the herpesvirus genome is introduced into a mammalian cell, the recombinant herpesvirus can be produced and grown. As a host cell for the recombinant herpesvirus, any mammalian cell which can grow a wild-type herpesvirus strain can be used. Preferably, such a host cell is derived from a human, including, for example, but being not limited to, cord blood mononuclear cells, peripheral blood mononuclear cells, and SupT1 cells.

(Method for Producing a BAC Vector Containing a Human Herpesvirus Genome)

Various techniques (e.g., a technique using homologous recombination) can be used to produce a BAC vector containing a human herpesvirus by using a human herpesvirus (e.g., HHV-6A, HHV-6B, or HHV-7) genome and a BAC vector.

An example of the technique using homologous recombination is a technique using a nucleic acid having a linear BAC vector sequence linked with a sequence homologous to a human herpesvirus genome.

A method for producing a BAC vector comprising a human herpesvirus genome by using a nucleic acid having a linear BAC vector sequence linked with a sequence homologous to a human herpesvirus genome representatively comprises the steps of: (1) introducing the nucleic acid along with the human herpesvirus genome into appropriate hosts; (2) culturing the host cells to elicit homologous recombination between the homologous sequence linked with the linear BAC vector sequence and the human herpesvirus genome sequence; (3) screening the host cells for one which contains the human herpesvirus genome sequence having the BAC vector sequence incorporated due to the homologous recombination; (4) culturing the host cell and extracting a circular virus DNA. Examples of a host cell used in the above-described method include, but are not limited to, cord blood mononuclear cells, peripheral blood mononuclear cells, and SupT1 cells.

Examples of a technique for introducing a BAC vector into mammalian hosts include, but are not limited to, the calcium phosphate method, the electroporation method, and the lipofection method. By the electroporation method of Amaxa or Bio-Rad, a large amount of genes can be efficiently introduced into T cells. For example, the electroporation method of Amaxa is performed under the following conditions. For example, cells are washed with cell wash buffer solution (RPMI-1640 medium without fetal calf serum) twice. Thereafter, the cells are suspended in electroporation buffer solution (Nucleofector solution supplied by the manufacture). 1 μg of plasmid DNA is added to the cell suspension, mixed well, and placed in a cuvette. Electroporation is performed at room temperature using an appropriate program.

Alternatively, in order to produce a BAC containing a human herpesvirus genome using a human herpesvirus genome and a BAC sequence, various methods, such as use of nucleic acid fragments obtained using restriction enzymes or the like, can be employed instead of homologous recombination.

A non-essential region of the HHV-7 genome for introducing a BAC vector sequence thereinto selected from the group consisting of: a region within the ORF of gene H1, a region within the ORF of gene DR1, a region within the ORF of gene DR2, a region within the ORF of gene H2, a region within the ORF of gene DR6, a region within the ORF of gene DR7, a region within the ORF of gene H3, a region within the ORF of gene H4, a region within the ORF of gene U2, a region within the ORF of gene U3, a region within the ORF of gene U4, a region within the ORF of gene U5/7, a region within the ORF of gene U8, a region within the ORF of gene U10, a region within the ORF of gene U12, a region within the ORF of gene U13, a region within the ORF of gene U15, a region within the ORF of gene U16, a region within the ORF of gene U17Ex, a region within the ORF of gene U17, a region within the ORF of gene U17a, a region within the ORF of gene U18, a region within the ORF of gene U19, a region within the ORF of gene U20, a region within the ORF of gene U21, a region within the ORF of gene U23, a region within the ORF of gene U24, a region within the ORF of gene U24a, a region within the ORF of gene U25, a region within the ORF of gene U26, a region within the ORF of gene U28, a region within the ORF of gene U32, a region within the ORF of gene U33, a region within the ORF of gene U34, a region within the ORF of gene U35, a region within the ORF of gene U36, a region within the ORF of gene U37, a region within the ORF of gene U40, a region within the ORF of gene U42, a region within the ORF of gene U44, a region within the ORF of gene U45, a region within the ORF of gene U46, a region within the ORF of gene U47, a region within the ORF of gene U49, a region within the ORF of gene U50, a region within the ORF of gene U51, a region within the ORF of gene U52, a region within the ORF of gene U55A, a region within the ORF of gene U55B, a region within the ORF of gene U58, a region within the ORF of gene U59, a region within the ORF of gene U62, a region within the ORF of gene U63, a region within the ORF of gene U64, a region within the ORF of gene U65, a region within the ORF of gene U67, a region within the ORF of gene U68, a region within the ORF of gene U69, a region within the ORF of gene U70, a region within the ORF of gene U71, a region within the ORF of gene U75, a region within the ORF of gene U76, a region within the ORF of gene H5, a region within the ORF of gene U79, a region within the ORF of gene H6, a region within the ORF of gene U80, a region within the ORF of gene U81, a region within the ORF of gene U84, a region within the ORF of gene U85, a region within the ORF of gene U91, a region within the ORF of gene H7, a region within the ORF of gene U95, a region within the ORF of gene H8, a region flanking the ORF of gene H1, a region flanking the ORF of gene DR1, a region flanking the ORF of gene DR2, a region flanking the ORF of gene H2, a region flanking the ORF of gene DR6, a region flanking the ORF of gene DR7, a region flanking the ORF of gene H3, a region flanking the ORF of gene H4, a region flanking the ORF of gene U2, a region flanking the ORF of gene U3, a region flanking the ORF of gene U4, a region flanking the ORF of gene U5/7, a region flanking the ORF of gene U8, a region flanking the ORF of gene U10, a region flanking the ORF of gene U12, a region flanking the ORF of gene U13, a region flanking the ORF of gene U15, a region flanking the ORF of gene U16, a region flanking the ORF of gene U17Ex, a region flanking the ORF of gene U17, a region flanking the ORF of gene U17a, a region flanking the ORF of gene U18, a region flanking the ORF of gene U19, a region flanking the ORF of gene U20, a region flanking the ORF of gene U21, a region flanking the ORF of gene U23, a region flanking the ORF of gene U24, a region flanking the ORF of gene U24a, a region flanking the ORF of gene U25, a region flanking the ORF of gene U26, a region flanking the ORF of gene U28, a region flanking the ORF of gene U32, a region flanking the ORF of gene U33, a region flanking the ORF of gene U34, a region flanking the ORF of gene U35, a region flanking the ORF of gene U36, a region flanking the ORF of gene U37, a region flanking the ORF of gene U40, a region flanking the ORF of gene U42, a region flanking the ORF of gene U44, a region flanking the ORF of gene U45, a region flanking the ORF of gene U46, a region flanking the ORF of gene U47, a region flanking the ORF of gene U49, a region flanking the ORF of gene U50, a region flanking the ORF of gene U51, a region flanking the ORF of gene U52, a region flanking the ORF of gene U55A, a region flanking the ORF of gene U55B, a region flanking the ORF of gene U58, a region flanking the ORF of gene U59, a region flanking the ORF of gene U62, a region flanking the ORF of gene U63, a region flanking the ORF of gene U64, a region flanking the ORF of gene U65, a region flanking the ORF of gene U67, a region flanking the ORF of gene U68, a region flanking the ORF of gene U69, a region flanking the ORF of gene U70, a region flanking the ORF of gene U71, a region flanking the ORF of gene U75, a region flanking the ORF of gene U76, a region flanking the ORF of gene H5, a region flanking the ORF of gene U79, a region flanking the ORF of gene H6, a region flanking the ORF of gene U80, a region flanking the ORF of gene U81, a region flanking the ORF of gene U84, a region flanking the ORF of gene U85, a region flanking the ORF of gene U91, a region flanking the ORF of gene H7, a region flanking the ORF of gene U95, and a region flanking the ORF of gene H8.

Preferably non-essential regions in HHV-7 are ORF regions of gene U24, gene U24a, gene U25, and gene U26, or regions flanking these ORF's. This is because gene U24, gene U24a, gene U25, and gene U26 are contiguous non-essential genes on the HHV-7 genome, so that it is easy to design a nucleic acid for homologous recombination.

A BAC vector sequence used in the present invention preferably includes a recombinant protein-dependent recombinant sequence and/or a selectable marker. Preferably, the selectable marker sequence is a drug selectable marker and/or a gene encoding a green fluorescent protein. This is because the presence of a desired gene can be easily confirmed.

According to another aspect of the present invention, a vector used for production of the above-described virus and a method for producing the above-described virus are provided. According to still another aspect of the present invention, a pharmaceutical composition comprising the above-described virus and a pharmaceutical composition in the form of a vaccine are provided.

The recombinant human herpesvirus of the present invention can be used to introduce a desired antigen protein. Therefore, for example, when an antigen which is known to function as a vaccine is introduced, the vector of the present invention can be used as a vaccine vector.

According to still another aspect of the present invention, a method for introducing mutation into a vector for producing a vaccine of the present invention is provided. The method comprises the steps of: introducing a vector into a bacterial host cell; introducing a plasmid vector containing a fragment consisting of a portion of a human herpesvirus genome into the bacterial host cell, wherein the fragment has at least one mutation; culturing the bacterial host cell; and isolating a vector having a BAC vector sequence from the cultured bacterial host cell. In the above-described method, homologous recombination occurs between the vector for producing a vaccine of the present invention and the plasmid vector containing the fragment consisting of the portion of the human herpesvirus genome, in bacterial host cells. As a result, the vector for producing the vaccine of the present invention has a mutation in the fragment consisting of the portion of the human herpesvirus genome.

In the above-described method, the step of introducing the vector into bacterial host cells can be achieved by using various well-known methods, such as electroporation and the like. Similarly, the plasmid vector containing the fragment consisting of the portion of the human herpesvirus genome can be introduced into bacterial host cells. As a technique for introducing a mutation into the fragment, a technique for introducing a mutation by using PCR is well known. For example, by using heat-resistant polymerase having no proofreading function, where one of the four nucleotides is in lower quantity, it is possible to introduce a mutation randomly. Alternatively, by PCR using a primer having a mutated base sequence, it is possible to introduce a desired mutation into a desired site. When the bacterial cell is cultured, homologous recombination occurs between the vector for producing the vaccine of the present invention and the plasmid vector containing the fragment consisting of the portion of the human herpesvirus genome. As a result, the vector for producing the vaccine of the present invention has a mutation in the fragment consisting of the portion of the human herpesvirus genome. In order to prepare a BAC vector sequence from a bacterial host cell, various well-known techniques (e.g., the alkaline method, etc.) and commercially available kits can be used.

According to another aspect of the present invention, another method for introducing a mutation into a vector for producing the vaccine of the present invention is provided. The method comprises the steps of: introducing the vector into a bacterial host cell; introducing a first plasmid vector containing a first fragment consisting of a portion of a human herpesvirus genome into the bacterial host cell, wherein the first fragment has at least one mutation; introducing a second plasmid vector containing a second fragment consisting of a portion of the human herpesvirus genome into the bacterial host cell, wherein the second fragment has at least one mutation and the second fragment is different from the first fragment; culturing the bacterial host cell; and isolating a vector having a BAC vector sequence from the cultured bacterial host cell.

According to an aspect of the present invention, a nucleic acid cassette which may be used for producing the vaccine of the present invention, is provided. The nucleic acid cassette preferably comprises a first fragment capable of homologous recombination with a human herpesvirus genome in a host cell, a BAC vector sequence, and a second fragment capable of homologous recombination with a human herpesvirus genome in the host cell, wherein the opposite ends of the BAC sequence are linked with the first fragment and second fragments, respectively. In this case, the first fragment and the second fragment are preferably at least 1 kb, at least 1.5 kb, or at least 2 kb in length. The first fragment and the second fragment preferably has at least 80% identity, at least 85% identity, at least 90% identity, or at least 95% identity to the human herpesvirus genome sequence.

Preferably, the first and second fragments are derived from different regions of the human herpesvirus genome. The first and second fragments may be independently derived from a region flanking the ORF of gene U24 or a region flanking the ORF of gene U24a. Preferably, the BAC vector sequence comprises a recombinant protein-dependent recombinant sequence and/or a selectable marker in order to control homologous recombination and easily detect a desired gene. The selectable marker may be either a drug selectable marker or a gene encoding a fluorescent protein (e.g., a green fluorescent protein, etc.). Representatively, the BAC vector sequence has a nucleic acid sequence set forth in SEQ ID NO.: 401.

In the case of HHV-7, preferably, the first and second fragments are independently derived from regions selected from the group consisting of the following regions of the HHV-7 genome, or independently have at least 80%, 85%, 90%, or 95% identity to regions selected from the group consisting of the following regions of the HHV-7 genome: a region within the ORF of gene H1, a region within the ORF of gene DR1, a region within the ORF of gene DR2, a region within the ORF of gene H2, a region within the ORF of gene DR6, a region within the ORF of gene DR7, a region within the ORF of gene H3, a region within the ORF of gene H4, a region within the ORF of gene U2, a region within the ORF of gene U3, a region within the ORF of gene U4, a region within the ORF of gene U5/7, a region within the ORF of gene U8, a region within the ORF of gene U10, a region within the ORF of gene U12, a region within the ORF of gene U13, a region within the ORF of gene U15, a region within the ORF of gene U16, a region within the ORF of gene U17Ex, a region within the ORF of gene U17, a region within the ORF of gene U17a, a region within the ORF of gene U18, a region within the ORF of gene U19, a region within the ORF of gene U20, a region within the ORF of gene U21, a region within the ORF of gene U23, a region within the ORF of gene U24, a region within the ORF of gene U24a, a region within the ORF of gene U25, a region within the ORF of gene U26, a region within the ORF of gene U28, a region within the ORF of gene U32, a region within the ORF of gene U33, a region within the ORF of gene U34, a region within the ORF of gene U35, a region within the ORF of gene U36, a region within the ORF of gene U37, a region within the ORF of gene U40, a region within the ORF of gene U42, a region within the ORF of gene U44, a region within the ORF of gene U45, a region within the ORF of gene U46, a region within the ORF of gene U47, a region within the ORF of gene U49, a region within the ORF of gene U50, a region within the ORF of gene U51, a region within the ORF of gene U52, a region within the ORF of gene U55A, a region within the ORF of gene U55B, a region within the ORF of gene U58, a region within the ORF of gene U59, a region within the ORF of gene U62, a region within the ORF of gene U63, a region within the ORF of gene U64, a region within the ORF of gene U65, a region within the ORF of gene U67, a region within the ORF of gene U68, a region within the ORF of gene U69, a region within the ORF of gene U70, a region within the ORF of gene U71, a region within the ORF of gene U75, a region within the ORF of gene U76, a region within the ORF of gene H5, a region within the ORF of gene U79, a region within the ORF of gene H6, a region within the ORF of gene U80, a region within the ORF of gene U81, a region within the ORF of gene U84, a region within the ORF of gene U85, a region within the ORF of gene U91, a region within the ORF of gene H7, a region within the ORF of gene U95, a region within the ORF of gene H8, a region flanking the ORF of gene H1, a region flanking the ORF of gene DR1, a region flanking the ORF of gene DR2, a region flanking the ORF of gene H2, a region flanking the ORF of gene DR6, a region flanking the ORF of gene DR7, a region flanking the ORF of gene H3, a region flanking the ORF of gene H4, a region flanking the ORF of gene U2, a region flanking the ORF of gene U3, a region flanking the ORF of gene U4, a region flanking the ORF of gene U5/7, a region flanking the ORF of gene U8, a region flanking the ORF of gene U10, a region flanking the ORF of gene U12, a region flanking the ORF of gene U13, a region flanking the ORF of gene U15, a region flanking the ORF of gene U16, a region flanking the ORF of gene U17Ex, a region flanking the ORF of gene U17, a region flanking the ORF of gene U17a, a region flanking the ORF of gene U18, a region flanking the ORF of gene U19, a region flanking the ORF of gene U20, a region flanking the ORF of gene U21, a region flanking the ORF of gene U23, a region flanking the ORF of gene U24, a region flanking the ORF of gene U24a, a region flanking the ORF of gene U25, a region flanking the ORF of gene U26, a region flanking the ORF of gene U28, a region flanking the ORF of gene U32, a region flanking the ORF of gene U33, a region flanking the ORF of gene U34, a region flanking the ORF of gene U35, a region flanking the ORF of gene U36, a region flanking the ORF of gene U37, a region flanking the ORF of gene U40, a region flanking the ORF of gene U42, a region flanking the ORF of gene U44, a region flanking the ORF of gene U45, a region flanking the ORF of gene U46, a region flanking the ORF of gene U47, a region flanking the ORF of gene U49, a region flanking the ORF of gene U50, a region flanking the ORF of gene U51, a region flanking the ORF of gene U52, a region flanking the ORF of gene U55A, a region flanking the ORF of gene U55B, a region flanking the ORF of gene U58, a region flanking the ORF of gene U59, a region flanking the ORF of gene U62, a region flanking the ORF of gene U63, a region flanking the ORF of gene U64, a region flanking the ORF of gene U65, a region flanking the ORF of gene U67, a region flanking the ORF of gene U68, a region flanking the ORF of gene U69, a region flanking the ORF of gene U70, a region flanking the ORF of gene U71, a region flanking the ORF of gene U75, a region flanking the ORF of gene U76, a region flanking the ORF of gene H5, a region flanking the ORF of gene U79, a region flanking the ORF of gene H6, a region flanking the ORF of gene U80, a region flanking the ORF of gene U81, a region flanking the ORF of gene U84, a region flanking the ORF of gene U85, a region flanking the ORF of gene U91, a region flanking the ORF of gene H7, a region flanking the ORF of gene U95, and a region flanking the ORF of gene H8.

Preferably, the first and second fragments are derived from different regions of the human herpesvirus genome. The first and second fragments may be independently derived from a region flanking the ORF of gene U24 or a region flanking the ORF of gene U24a. Preferably, the BAC vector sequence comprises a recombinant protein-dependent recombinant sequence and/or a selectable marker in order to control homologous recombination and easily detect a desired gene. The selectable marker may be either a drug selectable marker or a gene encoding a fluorescent protein (e.g., a green fluorescent protein, etc.). Representatively, the BAC vector sequence has a nucleic acid sequence set forth in SEQ ID NO.: 401.

(Preparation of Recombinant Herpesvirus Containing a Foreign Gene)

A method of the present invention can be used to easily prepare a herpesvirus having a herpesvirus genome into which a foreign gene is introduced.

Such mutation introduction can be performed by using a method described below regarding, for example, HHV-7.

Into *E. coli*, (a) HHV-7-U21-27-BAC plasmid (a plasmid containing the HHV-7 genome and a BAC vector sequence) and (b) a nucleic acid encoding a mutated foreign gene (e.g., a shuttle vector or a PCR product) having a desired foreign gene and partial sequences of a herpesvirus genome linked with the opposite ends of the foreign gene, are introduced. Homologous recombination is allowed to occur between HHV-7-U21-27-BAC plasmid and the shuttle vector or PCR product, so that a foreign gene mutation can be introduced into HHV-7-U21-27-BAC plasmid. Alternatively, a transposon can be used to randomly introduce a mutation into a desired nucleic acid sequence. The HHV-7-U21-27-BAC plasmid into which the foreign gene has been introduced, can be easily selected and grown in *E. coli*. By causing HHV-7-U21-27-BAC having the foreign gene to produce a virus, the recombinant herpesvirus can be obtained (Markus Wagner, TRENDS in Microbiology, Vol. 10, No. 7, July 2002). Specific examples will be described below.

(1) Use of a Temperature Sensitive Shuttle Vector Containing a Foreign Gene Nucleic Acid:

Firstly, the shuttle vector and HHV-7-U21-27-BAC plasmid are allowed to recombine via a first homologous region to generate a cointegrate in which the shuttle vector is linked with HHV-7-U21-27-BAC plasmid. Next, since the replication origin of the shuttle vector is temperature-sensitive, the shuttle plasmid is removed. In a second recombination event, the cointegrated portion is removed. When the second recombination event occurs via the first homologous region, a plasmid having the same sequence as that of HHV-7-U21-27-BAC used for the recombination is generated. In contrast, when the second recombination event occurs via a second homologous region different from the first homologous region, a modified HHV-7-U21-27-BAC plasmid having the foreign gene contained in the shuttle vector is obtained. When the first homologous region and the second homologous region have substantially the same length, the probability that the second recombination event occurs in the second homologous region is substantially the same as the probability that the second recombination event occurs in the first homologous region. Therefore, about half of the resultant HHV-7-U21-27-BAC plasmids are plasmids having the same sequence as that which has been used in the recombination, while about half thereof are plasmids having the foreign gene which has been introduced into the shuttle vector.

(2) Use of a Linear DNA Fragment:

In this method, for example, by utilizing the recombination function of recET derived from prophage Rac or the recombination function of red$\alpha\beta$ derived from bacteriophage $\lambda$, a linear DNA fragment is used to introduce a mutation into a circular HHV-7-U21-27-BAC molecule. Specifically, a selectable marker flanking a target sequence and a linear DNA fragment containing a homologous sequence are introduced along with HHV-7-U21-27-BAC into *E. coli* capable of homologous recombination. In order to avoid the degradation of the linear DNA within *E. coli*, it is preferable to use *E. coli* lacking exonuclease or cause expression of red$\gamma$ (gam) which is an exonuclease inhibitor derived from a bacteriophage. The linear DNA has a region homologous to HHV-7-U21-27-BAC plasmid on the opposite ends thereof. Homologous recombination occurs via the homologous region, thereby making it possible to introduce a desired sequence of the linear DNA fragment into HHV-7-U21-27-BAC. RecET and red$\alpha\beta$ exhibit homologous recombination via a homologous sequence having a length of about 25 to 50 nucleotides. Therefore, the recombination functions of recET and red$\alpha\beta$ can be used more easily than recA-mediated homologous recombination.

(3) Use of a Transposon:

The function of a transposon element to insert into a nucleic acid in *E. Coli* is used. For example, a transposon element containing a desired foreign gene and HHV-7-U21-27-BAC are introduced into *E. coli* so that the transposon element is randomly inserted into HHV-7-U21-27-BAC. Thereby, HHV-7-U21-27-BAC having the inserted foreign gene is obtained.

The above-described method for preparing recombinant HHV-7 containing a foreign gene can be applied to HHV-6.

(Effect of HIV Therapy Using the Recombinant HHV-7 of the Present Invention (Prevention of Infection))

HIV infects CD4$^+$ T cells. It is known that HIV infection is prevented or healed by the treatment of CD4$^+$ T cells with HHV-7 (Lusso et al., Proc. Natl. Acad. Sci. USA, vol. 91, 3872-3876, April 1994). This therapeutic effect is achieved by HHV-7 infecting CD4$^+$ T cells via the CD4 receptor on the T cells. Therefore, recombinant HHV-7 which has infectious capacity to CD4$^+$ T cells can be prepared by a method of the present invention and can be used for the prevention and/or therapy of HIV infection.

The HIV infection preventing effect of HHV-7 of the present invention can be measured by determining whether or not HHV-7 prevents the growth of HIV in target cells. Examples of target cells used for measurement include, but are not limited to, peripheral blood mononuclear cells, CD4$^+$ cells, SupT1 cells, and the like. More specifically, for example, measurement can be performed as follows.

Target cells are previously infected with HHV-7 at a multiplicity of infection (MOI) of 0.1, followed by culturing at 37° C. for 24 to 72 hours. Thereafter, HIV is added, followed by incubation for 30 minutes to 2 hours. Thereafter, the cells are well washed, and incubated again. After 4 days of incubation, HIV-derived antigens released in culture medium are quantitated. As a control, cells which have not been subjected to HHV-7 infection are infected with HIV under the same conditions, and antigens released into culture medium are measured. An example of an HIV-derived antigen is, but is not limited to, p24. The quantity of the antigen serves as an index of HIV growth. Therefore, if the antigen quantity is small compared to that of the control, the HIV infection preventing effect of HHV-7 is demonstrated.

The therapeutic effect on HIV infection of HHV-7 of the present invention can be measured by determining whether or not HHV-7 suppresses the growth ability of HIV in target cells. Examples of target cells used for measurement include, but are not limited to, peripheral blood mononuclear cells, CD4$^+$ cells, SupT1 cells, and the like. More specifically, for example, measurement can be performed as follows.

Target cells are coinfected with HIV and HHV-7 (MOI of 0.1 to 0.01). After coinfection, the infected cells are incubated for about 30 minutes to 2 hours. Thereafter, the cells are well washed, and incubated again. As a control, cells which have been subjected to HIV infection without HHV-7 infection are used. After 4 days of incubation, HIV-derived antigens in culture medium are quantitated. An example of an HIV-derived antigen is, but is not limited to, p24. The quantity of the antigen serves as an index of HIV growth. Therefore, if the antigen quantity is small compared to that of the control, the HIV infection preventing effect of HHV-7 is demonstrated.

(HIV Therapy Using Recombinant HHV-7 and HHV-6 of the Present Invention)

Recombinant HHV-7 or HHV-6 of the present invention can be used to treat HIV. For example, a silencer gene for a HIV gene is introduced into recombinant HHV-7, and the recombinant HHV-7 is administered into HIV patients. When CD4$^+$ T cells infected with HIV are infected with recombinant HHV-7, the production of HIV is suppressed. As a result, a therapeutic effect is exhibited on HIV infection.

Alternatively, since opportunistic infection is caused by CMV (cytomegalovirus), it is possible to enhance a defense against CMV using recombinant HHV-7 in which an antigen is incorporated.

(Formulation)

The present invention also provides methods of treatment and/or prevention of diseases or disorders (e.g., infectious diseases) by administration to a subject of an effective amount of a therapeutic/prophylactic agent. By the therapeutic/prophylactic agent is meant a composition of the present invention in combination with a pharmaceutically acceptable carrier type (e.g., a sterile carrier).

The therapeutic/prophylactic agent will be formulated and dosed in a fashion consistent with good medical practice, taking into account the clinical condition of the individual patient (especially the side effects of treatment with the therapeutic/prophylactic agent alone), the site of delivery, the method of administration, the scheduling of administration, and other factors known to those skilled in the art. The "effective amount" for purposes herein is thus determined by such considerations.

As a general proposition, the total pharmaceutically effective amount of the therapeutic/prophylactic agent administered parenterally per dose will be in the range of about 1 μg/kg/day to 10 mg/kg/day of patient body weight, although, as noted above, this will be subject to therapeutic discretion. More preferably, this dose is at least 0.01 mg/kg/day, and most preferably for humans between about 0.01 and 1 mg/kg/day for the cellular physiologically active material of the present invention. If given continuously, the therapeutic/prophylactic agent is typically administered at a dose rate of about 1 μg/kg/hour to about 50 μg/kg/hour, either by 1-4 injections per day or by continuous subcutaneous infusions, for example, using a mini-pump. An intravenous bag solution may also be employed. The length of treatment needed to observe changes and the interval following treatment for responses to occur appears to vary depending on the desired effect.

The therapeutic/prophylactic agents can be administered orally, rectally, parenterally, intracisternally, intravaginally, intraperitoneally, topically (as by powders, ointments, gels, drops or transdermal patch), or as an oral or nasal spray. "Pharmaceutically acceptable carrier" refers to a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

The therapeutic/prophylactic agents of the invention are also suitably administered by sustained-release systems. Suitable examples of sustained-release therapeutic/prophylactic agents are administered orally, rectally, parenterally, intracisternally, intravaginally, intraperitoneally, topically (as by powders, ointments, gels, drops or transdermal patch), or as an oral or nasal spray. "Pharmaceutically acceptable carrier" refers to a non-toxic solid, semisolid or liquid filler, diluent, encapsulating material or formulation auxiliary of any type. The term "parenteral" as used herein refers to modes of administration which include intravenous, intramuscular, intraperitoneal, intrasternal, subcutaneous and intraarticular injection and infusion.

For parenteral administration, in one embodiment, the therapeutic/prophylactic agent is formulated generally by mixing it at the desired degree of purity, in a unit dosage injectable form (solution, suspension, or emulsion), with a pharmaceutically acceptable carrier, i.e., one that is non-toxic to recipients at the dosages and concentrations employed and is compatible with other ingredients of the formulation. For example, the formulation preferably does not include oxidizing agents and other compounds that are known to be deleterious to the therapeutic/prophylactic agent.

Generally, the formulations are prepared by contacting the therapeutic/prophylactic agent uniformly and intimately with liquid carriers or finely divided solid carriers or both. Then, if necessary, the product is shaped into the desired formulation. Preferably the carrier is a parenteral carrier, more preferably a solution that is isotonic with the blood of the recipient. Examples of such carrier vehicles include water, saline, Ringer's solution, and dextrose solution. Non-aqueous vehicles such as fixed oils and ethyl oleate are also useful herein, as well as liposomes.

The carrier suitably contains minor amounts of additives such as substances that enhance isotonicity and chemical stability. Such materials are non-toxic to recipients at the dosages and concentrations employed, and include buffers such as phosphate, citrate, succinate, acetic acid, and other organic acids or their salts; antioxidants such as ascorbic acid; low molecular weight (less than about ten residues) polypeptides, e.g., polyarginine or tripeptides; proteins, such as serum albumin, gelatin, or immunoglobulins; hydrophilic polymers such as polyvinylpyrrolidone; amino acids, such as glycine, glutamic acid, aspartic acid, or arginine; monosaccharides, disaccharides, and other carbohydrates including cellulose or its derivatives, glucose, manose, or dextrins; chelating agents such as EDTA; sugar alcohols such as mannitol or sorbitol; counterions such as sodium; and/or nonionic surfactants such as polysorbates, poloxamers, or PEG.

Any pharmaceutical used for therapeutic administration can be free from organisms and viruses other than a virus as an effective ingredient, i.e., sterile. Sterility is readily accomplished by filtration through sterile filtration membranes (e.g., 0.2 micron membranes). Therapeutic/prophylactic agents generally are placed into a container having a sterile access port, for example, an intravenous solution bag or vial having a stopper pierceable by a hypodermic injection needle.

Therapeutic/prophylactic agents ordinarily will be stored in unit or multi-dose containers, for example, sealed ampoules or vials, as an aqueous solution or as a lyophilized formulation for reconstitution. As an example of a lyophilized formulation, 10-ml vials are filled with 5 ml of sterile-filtered 1% (w/v) aqueous therapeutic/prophylactic agent solution, and the resulting mixture is lyophilized. The infusion solution is prepared by reconstituting the lyophilized therapeutic/prophylactic agent using bacteriostatic Water-for-injection.

The invention also provides a pharmaceutical pack or kit comprising one or more containers filled with one or more of the ingredients of the therapeutic/prophylactic agents of the invention. Associated with such container (s) can be a notice in the form prescribed by a governmental agency regulating the manufacture, use or sale of pharmaceuticals or biological products, which notice reflects approval by the agency of manufacture, use or sale for human administration. In addition, the therapeutic/prophylactic agents may be employed in conjunction with other therapeutic compounds.

The therapeutic/prophylactic agents of the invention may be administered alone or in combination with other therapeutic/prophylactic agents.

The therapeutic/prophylactic agents of the invention may be administered alone or in combination with other therapeutic agents. Therapeutic/prophylactic agents that may be administered in combination with the therapeutic/prophylactic agents of the invention, include but not limited to, chemotherapeutic agents, antibiotics, steroidal and nonsteroidal anti-inflammatories, conventional immunotherapeutic agents, cytokines and/or growth factors. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

In certain embodiments, the therapeutic/prophylactic agents of the invention are administered in combination with antiretroviral agents, nucleoside reverse transcriptase inhibitors, nonnucleoside reverse transcriptase inhibitors, and/or protease inhibitors.

In a further embodiment, the therapeutic/prophylactic agents of the invention are administered in combination with an antibiotic agent. Antibiotic agents that may be used include, but are not limited to, aminoglycoside antibiotics, polyene antibiotics, penicillin antibiotics, cephem antiboitics, peptide antibiotics, microride antibiotics, and tetracycline antibiotics.

In an additional embodiment, the therapeutic/prophylactic agents of the invention are administered alone or in combination with an anti-inflammatory agent. Anti-inflammatory agents that may be administered with the therapeutic/prophylactic agents of the invention include, but are not limited to, glucocorticoids and the nonsteroidal anti-inflammatories, aminoarylcarboxylic acid derivatives, arylacetic acid derivatives, arylbutyric acid derivatives, arylcarboxylic acids, arylpropionic acid derivatives, pyrazoles, pyrazolones, salicylic acid derivatives, thiazinecarboxamides, e-acetamidocaproic acid, S-adenosylmethionine, 3-amino-4-hydroxybutyric acid, amixetrine, bendazac, benzydamine, bucolome, difenpiramide, ditazol, emorfazone, guaiazulene, nabumetone, nimesulide, orgotein, oxaceprol, paranyline, perisoxal, pifoxime, proquazone, proxazole, and tenidap.

In a further embodiment, the therapeutic/prophylactic agent of the present invention is administered in combination with other therapeutic/prophylactic regimens (e.g., radiation therapy).

Hereinafter, the present invention will be described by way of examples. However, the present invention is not limited to these examples.

Example 1

Preparation of Recombinant Herpesvirus (1: Preparation of BAC Plasmid)

Plasmid PHA-2 used was kindly provided by Markus Wagner and Ulrich H. Koszinowski (Adler et al., (2000), J. Virol. 74: 6964-74). To prepare a recombinant virus, a BAC vector was inserted into the center of a region of about 4000 bp extending over gene U21, gene U23, gene U24, gene U24a, gene U25, and gene U26. This is because the insertion of a foreign nucleic acid into such a non-essential region was expected to have no adverse effect on the replication of herpesvirus. A scheme of inserting a BAC vector into the HHV-7 genome is schematically shown in FIG. 1.

The genomic DNA of herpesvirus strain KHR was used as a template to amplify primers BAC7-E1 (ATGCGGC-CGCGCGAGTGATAGGTACTTTCT) (SEQ ID NO.: 402) and BAC7-E2 (GCTTAATTAATATATAAGTCCTTCAAT-AGC) (SEQ ID NO.: 403), and primers BAC7-E3 (GCT-TAATTAACATGCTCTGCAATGCAAGCC) (SEQ ID NO.: 404) and BAC7-E4 (ATGCGGCCGCAAATAGC-CTTTGCTCATAGC) (SEQ ID NO.: 405).

(2: Preparation of Recombinant Virus by Homologous Recombination)

The prepared plasmid pHA-2/HHV7-U21-27 contains a guanine phosphoribosyl transferase (gpt) gene as a selectable marker. The BAC vector sequence is sandwiched between two loxP sequences. Therefore, the BAC vector sequence sandwiched between the loxP sequences can be efficiently removed by the action of Cre recombinase. In addition, cells into which the plasmid containing the BAC vector sequence has been introduced can be easily confirmed by the fluorescence of a green fluorescent protein (GFP).

The plasmid was digested with NotI for linearization. Nucleofection unit (Amaxa) was used to transfect cord blood mononuclear cells cultured in a 25-cm$^2$ plastic flask with 1 µg of the linearized pHA-2/HHV7U21-27 by electroporation. One day after transfection, the transfected cells were infected with herpesvirus KHR strain.

Mycophenolic acid (12.5 µg/ml) and 100 µg/ml xanthine were used to screen recombinant viruses based on the gpt gene. In the cord blood mononuclear cells, the cytopathic effect (CPE) typical for herpesvirus was observed. Some of the cells could be confirmed under a microscope to express the GFP. This result indicates that the cord blood mononuclear cell having the introduced pHA-2/HHV-7-U21-U27 were infected with herpesvirus. The GFP-positive infected cells were cultured for 7 days, and then co-cultured with newly separated and cultured cord blood mononuclear cells for infection. The proportion of cells expressing GFP was increased in the presence of mycophenolic acid and xanthine. This indicates that the BAC vector was inserted into the herpesvirus genome and a recombinant virus was produced (FIG. 2).

(3: Enrichment of Recombinant Virus and Introduction of it into *E. Coli*)

A recombinant virus was enriched by selection using the gpt gene in combination with mycophenolic acid and xanthine. The recombinant virus was used to infect SupT1 cells. After 6 hours, the cells were recovered and circular DNA was extracted from the cells. The circular DNA collected from the SupT1 cells was introduced into *E. coli*. The *E. coli* cells were disseminated on plates containing drugs. DNA was extracted from colonies which appeared on the plates. From the infected cells, circular virus DNA was extracted by Hirt's method (Hirt, (1967), J. M. Biol, 26: 365-9). The extracted DNA was introduced into *E. coli* DH10B by the electroporation method (0.1-cm cuvette, 2.5 kV) using the gene pulser (Bio-Rad) for transformation. *E. coli* containing HHV-7U21-27-BAC was obtained by screening on agar containing 17 µg/ml chloramphenicol.

(4: Stability of HHV-7-U21-27-BAC Plasmid in *E. coli*)

HHV-7U21-27-BAC was extracted from the bacteria using the NucleoBond PC 100 kit (Macherey-Nagel) in accordance with the protocol accompanying the kit. The resultant two clones were digested with restriction enzyme EcoRI.

(5: Production of Virus from HHV-7-U21-27-BAC)

HHV-7U21-27-BAC DNA (1 µg) was introduced into cord blood mononuclear cells ($5 \times 10^6$ to $10^7$) cultured in a 25-cm$^2$ plastic flask by the electroporation method. Electroporation was conducted using the nucleofactor kit (Amaxa) using the program T-08 in accordance with its manual. After electroporation, the mononuclear cells having the introduced gene were cultured in medium containing PHA (phytohemagglutinin) for 3 to 7 days.

Three to seven days after electroporation, the cord blood mononuclear cells were recovered, and were co-cultured with cord blood mononuclear cells ($5 \times 10^6$ to $10^7$) which were newly stimulated with PHA. In this case, the cells were cultured in PHA-free medium which contained drugs (MPA, xanthine). After coculturing, viral production was observed on day 2 to 3.

(6: Cutting Out of BAC Vector Sequence)

Recombinant adenovirus (AxCANCre) capable of expressing Cre recombinase (Tanaka M. et al., J. Virol., 2003 January; 77(2): 1382-1391) was kindly provided by Yasushi Kawaguchi of the Tokyo Medical and Dental University. Cord blood mononuclear cells were infected with the recombinant adenovirus at a MOI of 100. After 2 hours of virus adsorption, the cells were washed with PBS(−), followed by culturing in RPMI medium containing 5% FCS. The cord blood mononuclear cells were superinfected with recombinant human herpesvirus 24 hours after infection with recombinant adenovirus. A control experiment was conducted to confirm that the recombinant adenovirus expressed Cre recombinase and a BAC vector sequence was efficiently cut out from the HHV-7U21-27-BAC genome. The result of DNA sequencing of the obtained human herpesvirus confirmed that a BAC vector sequence was cut from HHV-7U21-27-BAC.

Example 2

Characterization of Recombinant Herpesvirus (1: Comparison of Growth Ability of Recombinant Viruses)

HHV-7 (KHR strain) and the obtained recombinant herpesvirus are compared in terms of the growth ability in cord blood mononuclear cells or SupT1 cells using the Median tissue culture infectious dose (TCID50) method. Cord blood mononuclear cells are infected with KHR strain and recombinant virus having the same titier, followed by culturing from day 0 to day 7. Thereafter, new cord blood mononuclear cells or SupT1 cells are infected with the viruses to compare the replication ability thereof. The titer is measured by the TCID method. The resultant recombinant human herpesvirus is confirmed to exhibit substantially the same replication ability as that of human herpesvirus KHR strain in vitro.

Example 3

The method of the present invention is used to readily prepare a herpesvirus having a genome into which an HIV silencer gene (e.g., an antisense nucleic acid to an HIV gene) by steps described below.

A shuttle vector is prepared, in which the NFκB/Sp1 site of the U3 site of LTR in HIV is operatively linked upstream of the HIV silencer gene, and a region flanking a non-essential gene of HHV-7 is linked to the opposite ends of the resultant sequence. The shuttle vector and HHV-7U21-27-BAC plasmid (a plasmid containing the HHV-7 genome and a BAC vector sequence) are introduced into *E. coli*. As a result, homologous recombination occurs between the HHV-7-U21-27-BAC plasmid and the shuttle vector in the *E. Coli* to produce a cointegrate in which the foreign gene (HIV silencer gene) contained in the shuttle vector is introduced into the HHV-7U21-27-BAC plasmid.

Next, since the replication origin of the shuttle vector is temperature-sensitive, the shuttle plasmid is removed. In a second recombination event, the cointegrated portion is removed. When the second recombination event occurs via a first homologous region, a plasmid having the same sequence as that of HHV-7U21-27-BAC used in the recombination is generated. In contrast, when the second recombination event occurs via a second homologous region different from the first homologous region, a modified HHV-7U21-27-BAC plasmid having a foreign gene contained in the shuttle vector is obtained. When the first homologous region and the second homologous region have substantially the same length, the probability that the second recombination event occurs in the second homologous region is substantially the same as the probability that the second recombination event occurs in the first homologous region. Therefore, about half of the resultant HHV-7-U21-27-BAC plasmids are plasmids having the same sequence as that which has been used in the recombination, while about half thereof are plasmids having the foreign gene which has been introduced into the shuttle vector.

The plasmid containing the HIV silencer is used to prepare a recombinant HHV-7 virus. The recombinant virus can be used to treat HIV infection.

Example 4

Preparation of Recombinant Herpesvirus Strain Vaccine

According to the present invention, it is possible to prepare a mutant recombinant herpesvirus having an incorporated gene encoding a desired vaccine antigen using techniques described below, and use it as a vaccine.

(Production of Vaccine)

With the recombinant herpesvirus obtained in Example 1, SupT1 cells are inoculated and cultured in 20 Roux bottles having a culture area of 210 $cm^2$. After completion of culturing, the culture media containing the cells are frozen and thawed, followed by centrifugation at 3,000 rpm for 20 minutes at 4° C. The supernatant containing viruses released from the cells is collected, which is used as a live vaccine stock solution.

Example 5

Prevention of HIV Infection

The method of Lusso et al. (Proc. Natl. Acad. Sci. USA, vol. 91, 3872 to 3876, April 1994) is used to confirm that the recombinant HHV-7 of the present invention has an HIV infection preventing effect.

$CD4^+$ T cells are isolated from the peripheral blood of healthy adults by negative immunological magnet selection using mouse monoclonal antibodies (e.g., Becton Dickinson) for CD8, CD14, CD19, CD20 and CD56, and anti-mouse IgG antiserum (e.g., Dynal, Great Neck, N.Y.). The cells are stimulated with 1 μg/ml of purified phytohemagglutinin (e.g., Wellacome), followed by growth in the presence of 10 units/ml partially purified IL-2 (e.g., Boehringer Mannheim). Thus, $CD4^+$ T cells are prepared.

The HIV infection preventing effect of HHV-7 of the present invention can be measured by determining whether or not the HIV replication ability in $CD4^+$ T cell is suppressed by HHV-7. More specifically, the following procedure is used.

$CD4^+$ T cells (106) are infected with HHV-7 at a MOI of 0.01 to 0.1, followed by culturing at 37° C. for 48 hours. Thereafter, HIV (amount: $10^5$ cpm of reverse transcriptase) is added, followed by incubation for 37 minutes to 1 hour. Thereafter, the cells are well washed, and incubated again in a 24-well plate. In the post-wash incubation, IL-2 (10 units/ml) is added to culture medium. After 4 days of incubation (cell survival rate: more than 80%), p24 protein released in culture medium is quantitated with ELISA. As a control, cells which have not been subjected to HHV-7 infection are infected with HIV under the same conditions, and p24 protein released into culture medium are measured. The quantity of p24 protein serves as an index of HIV replication. Therefore, if the quantity of p24 protein is small compared to that of the control, the HIV infection preventing effect of HHV-7 is demonstrated.

Example 6

Therapy of HIV Infection

HHV-7 targets CD4 which is a target (entrance) of HIV for infection. Therefore, CD4 has been demonstrated to be able to be used for the prevention of HIV infection. In contrast, HHV-6, which is also a virus capable of infecting CD4$^+$ T cells as with HHV-7 and HIV, has a target protein different from that of HHV-7 or HIV. Therefore, HHV-6 can be used as a gene therapy vector for HIV infection by, for example, introducing a gene suitable for therapy, such as a suicide gene or the like, into HIV infected cells. More specifically, the following technique can be used.

CD4$^+$ T cells are prepared using the same method as described in Example 5. HIV is added to CD4$^+$ T cells ($10^6$), followed by incubation at 37° C. for 1 hour. Thereafter, the cells are well washed. The HIV infected cells are infected with HHV-6 (recombinant HHV-6 virus laking a gene activating the LTR of HIV) at a MOI of 1. IL-2 (10 units/ml) is added to the culture medium, followed by incubation at 37° C. for 1 hour. After incubation, p24 protein released into the culture medium is quantitated with ELISA. As a control, cells which have not been subjected to HHV-6 treatment are used, and p24 protein released into culture medium is measured. The quantity of p24 protein serves as an index of HIV replication. Therefore, if the quantity of p24 protein is small compared to that of the control, the HIV infection preventing effect of HHV-6 is demonstrated.

Although certain preferred embodiments have been described herein, it is not intended that such embodiments be construed as limitations on the scope of the invention except as set forth in the appended claims. Various other modifications and equivalents will be apparent to and can be readily made by those skilled in the art, after reading the description herein, without departing from the scope and spirit of this invention. All patents, published patent applications and publications cited herein are incorporated by reference as if set forth fully herein.

The present invention provides a method for producing a recombinant herpesvirus from a single virus strain using, for example, BAC (*E. coli* artificial chromosome), and a recombinant herpesvirus produced by the method. The present invention also provides a pharmaceutical composition comprising a recombinant herpesvirus.

Further, the present invention provides a vector comprising a herpesvirus genomic gene and a BAC vector sequence, a cell containing such a vector, and a nucleic acid cassette comprising a fragment capable of homologous recombination with a herpesvirus genome, and a BAC vector sequence.

Further, the present invention provides a pharmaceutical composition comprising a recombinant herpesvirus for the prevention and therapy of HIV infection.

DESCRIPTION OF SEQUENCE TABLE

SEQ ID NO.: 1, JI strain genome sequence

SEQ ID NO.: 2, H1 5'→3' direction 33-542 sequence of amino acids (hereinafter "AAs") 1-170

SEQ ID NO.: 3, DR25'→3' direction 898-2100 sequence of AAs 1-401

SEQ ID NO.: 4, H2 5'→3' direction 2267-2506 sequence of AAs 1-80

SEQ ID NO.: 5, DR65'→3' direction 2562-3050 sequence of AAs 1-163

SEQ ID NO.: 6, DR75'→3' direction 3122-3910 sequence of AAs 1-263

SEQ ID NO.: 7, U10 5'→3' direction 14608-15963 sequence of AAs 1-452

SEQ ID NO.: 8, U12 5'→3' direction 18396-19436 sequence of AAs 1-347

SEQ ID NO.: 9, U13 5'→3' direction 19521-19817 sequence of AAs 1-99

SEQ ID NO.: 10, U14 5'→3' direction 19885-21831 sequence of AAs 1-649

SEQ ID NO.: 11, U17a 5'→3' direction 24318-24587 sequence of AAs 1-90

SEQ ID NO.: 12, U30 5'→3' direction 37362-40178 sequence of AAs 1-939

SEQ ID NO.: 13, U31 5'→3' direction 40179-46358 sequence of AAs 1-2060

SEQ ID NO.: 14, U36 5'→3' direction 49118-50575 sequence of AAs 1-486

SEQ ID NO.: 15, U37 5'→3' direction 50577-51356 sequence of AAs 1-260

SEQ ID NO.: 16, U44 5'→3' direction 67143-67754 sequence of AAs 1-204

SEQ ID NO.: 17, U46 5'→3' direction 68930-69190 sequence of AAs 1-87

SEQ ID NO.: 18, U49 5'→3' direction 73003-73722 sequence of AAs 1-240

SEQ ID NO.: 19, U51 5'→3' direction 75304-76188 sequence of AAs 1-295

SEQ ID NO.: 20, U53 5'→3' direction 76957-78495 sequence of AAs 1-513

SEQ ID NO.: 21, U58 5'→3' direction 87563-89890 sequence of AAs 1-776

SEQ ID NO.: 22, U62 5'→3' direction 92017-92244 sequence of AAs 1-76

SEQ ID NO.: 23, U64 5'→3' direction 92829-94148 sequence of AAs 1-440

SEQ ID NO.: 24, U67 5'→3' direction 95984-97024 sequence of AAs 1-347

SEQ ID NO.: 25, U69 5'→3' direction 97371-99011 sequence of AAs 1-547

SEQ ID NO.: 26, U70 5'→3' direction 99013-100455 sequence of AAs 1-481

SEQ ID NO.: 27, U73 5'→3' direction 101693-104056 sequence of AAs 1-788

SEQ ID NO.: 28, U77 5'→3' direction 108435-110897 sequence of AAs 1-821

SEQ ID NO.: 29, H5 5'→3' direction 112811-113311 sequence of AAs 1-167

SEQ ID NO.: 30, U79 5'→3' direction 113502-114203 sequence of AAs 1-234

SEQ ID NO.: 31, H6 5'→3' direction 114257-114505 sequence of AAs 1-83

SEQ ID NO.: 32, U80 5'→3' direction 114557-115189 sequence of AAs 1-211

SEQ ID NO.: 33, U91 5'→3' direction 129122-129625 sequence of AAs 1-168

SEQ ID NO.: 34, H7 5'→3' direction 130829-132112 sequence of AAs 1-428

SEQ ID NO.: 35, U95 5'→3' direction 133382-136204 sequence of AAs 1-941

SEQ ID NO.: 36, H1' 5'→3' direction 139080-139589 sequence of AAs 1-170

SEQ ID NO.: 37, DR2' 5'→3' direction 139945-141147 sequence of AAs 1-401

SEQ ID NO.: 38, H2' 5'→3' direction 141314-141553 sequence of AAs 1-80

SEQ ID NO.: 39, DR6' 5'→3' direction 141609-142097 sequence of AAs 1-163

SEQ ID NO.: 40, DR7' 5'→3' direction 142169-142957 sequence of AAs 1-263

SEQ ID NO.: 41, DR1 5'→3' direction 368-826 nucleic acid sequence encoding AAs 1-153

SEQ ID NO.: 42, DR1 5'→3' direction 368-826 sequence of AAs 1-153

SEQ ID NO.: 43, U50 5'→3' direction 73538-75202 nucleic acid sequence encoding AAs 1-555

SEQ ID NO.: 44, U50 5'→3' direction 73538-75202 sequence of AAs 1-555

SEQ ID NO.: 45, U59 5'→3' direction 89838-90881 nucleic acid sequence encoding AAs 1-348

SEQ ID NO.: 46, U59 5'→3' direction 89838-90881 sequence of AAs 1-348

SEQ ID NO.: 47, U63 5'→3' direction 92216-92851 nucleic acid sequence encoding AAs 1-212

SEQ ID NO.: 48, U63 5'→3' direction 92216-92851 sequence of AAs 1-212

SEQ ID NO.: 49, U65 5'→3' direction 94111-95103 nucleic acid sequence encoding AAs 1-331

SEQ ID NO.: 50, U65 5'→3' direction 94111-95103 sequence of AAs 1-331

SEQ ID NO.: 51, U68 5'→3' direction 97024-97368 nucleic acid sequence encoding AAs 1-115

SEQ ID NO.: 52, U68 5'→3' direction 97024-97368 sequence of AAs 1-115

SEQ ID NO.: 53, U71 5'→3' direction 100392-100613 nucleic acid sequence encoding AAs 1-74

SEQ ID NO.: 54, U71 5'→3' direction 100392-100613 sequence of AAs 1-74

SEQ ID NO.: 55, U74 5'→3' direction 104007-105986 nucleic acid sequence encoding AAs 1-660

SEQ ID NO.: 56, U74 5'→3' direction 104007-105986 sequence of AAs 1-660

SEQ ID NO.: 57, DR1' 5'→3' direction 139415-139873 nucleic acid sequence encoding AAs 1-153

SEQ ID NO.: 58, DR1' 5'→3' direction 139415-139873 sequence of AAs 1-153

SEQ ID NO.: 59, genome sequence of strain JI (complementary strand)

SEQ ID NO.: 60, H3 3'→5' direction 3976-4224 sequence of AAs 1-83

SEQ ID NO.: 61, H4 3'→5' direction 4449-4745 sequence of AAs 1-99

SEQ ID NO.: 62, U2 3'→5' direction 6338-7417 sequence of AAs 1-360

SEQ ID NO.: 63, U3 3'→5' direction 7578-8732 sequence of AAs 1-385

SEQ ID NO.: 64, U4 3'→5' direction 8754-10382 sequence of AAs 1-543

SEQ ID NO.: 65, U5/7 3'→5' direction 10407-13004 sequence of AAs 1-866

SEQ ID NO.: 66, U8 3'→5' direction 13174-14262 sequence of AAs 1-363

SEQ ID NO.: 67, U11 3'→5' direction 15982-18249 sequence of AAs 1-756

SEQ ID NO.: 68, U15 3'→5' direction 22244-22564 sequence of AAs 1-107

SEQ ID NO.: 69, U17 3'→5' direction 23570-23836 sequence of AAs 1-89

SEQ ID NO.: 70, U18 3'→5' direction 24713-25600 sequence of AAs 1-296

SEQ ID NO.: 71, U19 3'→5' direction 25945-26922 sequence of AAs 1-326

SEQ ID NO.: 72, U21 3'→5' direction 28202-29494 sequence of AAs 1-431

SEQ ID NO.: 73, U23 3'→5' direction 29903-30418 sequence of AAs 1-172

SEQ ID NO.: 74, U24 3'→5' direction 30524-30772 sequence of AAs 1-83

SEQ ID NO.: 75, U25 3'→5' direction 30936-31898 sequence of AAs 1-321

SEQ ID NO.: 76, U27 3'→5' direction 32857-33951 sequence of AAs 1-365

SEQ ID NO.: 77, U28 3'→5' direction 34064-36484 sequence of AAs 1-807

SEQ ID NO.: 78, U29 3'→5' direction 36487-37347 sequence of AAs 1-287

SEQ ID NO.: 79, U32 3'→5' direction 46355-46627 sequence of AAs 1-91

SEQ ID NO.: 80, U34 3'→5' direction 47992-48768 sequence of AAs 1-259

SEQ ID NO.: 81, U35 3'→5' direction 48805-49119 sequence of AAs 1-105

SEQ ID NO.: 82, U38 3'→5' direction 51363-54401 sequence of AAs 1-1013

SEQ ID NO.: 83, U40 3'→5' direction 56832-58997 sequence of AAs 1-722

SEQ ID NO.: 84, U41 3'→5' direction 59000-62395 sequence of AAs 1-1132

SEQ ID NO.: 85, U42 3'→5' direction 62772-64352 sequence of AAs 1-527

SEQ ID NO.: 86, U43 3'→5' direction 64501-67086 sequence of AAs 1-862

SEQ ID NO.: 87, U45 3'→5' direction 67759-68898 sequence of AAs 1-380

SEQ ID NO.: 88, U47 3'→5' direction 69638-70579 sequence of AAs 1-314

SEQ ID NO.: 89, U48 3'→5' direction 70817-72889 sequence of AAs 1-691

SEQ ID NO.: 90, U52 3'→5' direction 76185-76949 sequence of AAs 1-255

SEQ ID NO.: 91, U54 3'→5' direction 78503-79870 sequence of AAs 1-456

SEQ ID NO.: 92, U55A 3'→5' direction 79918-81201 sequence of AAs 1-428

SEQ ID NO.: 93, U55B 3'→5' direction 81285-82577 sequence of AAs 1-431

SEQ ID NO.: 94, U56 3'→5' direction 82630-83511 sequence of AAs 1-294

SEQ ID NO.: 95, U57 3'→5' direction 83514-87551 sequence of AAs 1-1346

SEQ ID NO.: 96, U72 3'→5' direction 100636-101676 sequence of AAs 1-347

SEQ ID NO.: 97, U76 3'→5' direction 106667-108589 sequence of AAs 1-641

SEQ ID NO.: 98, U81 3'→5' direction 115184-115948 sequence of AAs 1-255

SEQ ID NO.: 99, U82 3'→5' direction 116038-116778 sequence of AAs 1-247

SEQ ID NO.: 100, U84 3'→5' direction 117111-118043 sequence of AAs 1-311

SEQ ID NO.: 101, U85 3'→5' direction 118071-118913 sequence of AAs 1-281

SEQ ID NO.: 102, U86 3'→5' direction 119091-122708 sequence of AAs 1-1206

SEQ ID NO.: 103, U89 3'→5' direction 125420-128668 sequence of AAs 1-1083

SEQ ID NO.: 104, U90 3'→5' direction 128776-129051 sequence of AAs 1-92

SEQ ID NO.: 105, H8 3'→5' direction 136307-136579 sequence of AAs 1-91

SEQ ID NO.: 106, U99 3'→5' direction 138375-138692 sequence of AAs 1-106

SEQ ID NO.: 107, U100 3'→5' direction 138751-138999 sequence of AAs 1-83

SEQ ID NO.: 108, H3' 3'→5' direction 143023-143271 sequence of AAs 1-83

SEQ ID NO.: 109, H4' 3'→5' direction 143496-143792 sequence of AAs 1-99

SEQ ID NO.: 110, U17Ex 3'→5' direction 22772-23547 and 23620-23836 nucleic acid sequence encoding AAs 1-331

SEQ ID NO.: 111, U17Ex 3'→5' direction 22772-23547 and 23620-23836 sequence of AAs 1-331

SEQ ID NO.: 112, U60-U66 3'→5' direction 90878-92005 and 95122-95985 nucleic acid sequence encoding AAs 1-664

SEQ ID NO.: 113, U60-U66 3'→5' direction 90878-92005 and 95122-95985 sequence of AAs 1-664

SEQ ID NO.: 114, U20 3'→5' direction 27036-28211 nucleic acid sequence encoding AAs 1-392

SEQ ID NO.: 115, U20 3'→5' direction 27036-28211 sequence of AAs 1-392

SEQ ID NO.: 116, U24a 3'→5' direction 30776-31129 nucleic acid sequence encoding AAs 1-118

SEQ ID NO.: 117, U24a 3'→5' direction 30776-31129 sequence of AAs 1-118

SEQ ID NO.: 118, U26 3'→5' direction 31988-32869 nucleic acid sequence encoding AAs 1-294

SEQ ID NO.: 119, U26 3'→5' direction 31988-32869 sequence of AAs 1-294

SEQ ID NO.: 120, U33 3'→5' direction 46608-48041 nucleic acid sequence encoding AAs 1-478

SEQ ID NO.: 121, U33 3'→5' direction 46608-48041 sequence of AAs 1-478

SEQ ID NO.: 122, U39 3'→5' direction 54401-56869 nucleic acid sequence encoding AAs 1-823

SEQ ID NO.: 123, U39 3'→5' direction 54401-56869 sequence of AAs 1-823

SEQ ID NO.: 124, U75 3'→5' direction 105973-106743 nucleic acid sequence encoding AAs 1-257

SEQ ID NO.: 125, U75 3'→5' direction 105973-106743 sequence of AAs 1-257

SEQ ID NO.: 126, U98 3'→5' direction 137945-138451 nucleic acid sequence encoding AAs 1-169

SEQ ID NO.: 127, U98 3'→5' direction 137945-138451 sequence of AAs 1-169

SEQ ID NO.: 128, genome sequence of strain U1102

SEQ ID NO.: 129, DR1, 5'→3' direction, 501-794, sequence of AAs 1-98

SEQ ID NO.: 130, DR4, 5'→3' direction, 2746-3048, sequence of AAs 1-101

SEQ ID NO.: 131, DR6, 5'→3' direction, 4725-5036, sequence of AAs 1-104

SEQ ID NO.: 132, DR7, 5'→3' direction, 5629-6720, sequence of AAs 1-364

SEQ ID NO.: 133, DR8, 5'→3' direction, 7237-7569, sequence of AAs 1-111

SEQ ID NO.: 134, U1, 5'→3' direction, 8245-8616, sequence of AAs 1-124

SEQ ID NO.: 135, U6, 5'→3' direction, 14619-14867, sequence of AAs 1-83

SEQ ID NO.: 136, U10, 5'→3' direction, 17604-18914, sequence of AAs 1-437

SEQ ID NO.: 137, U12, 5'→3' direction, 21856-22812, sequence of AAs 1-319

SEQ ID NO.: 138, U13, 5'→3' direction, 22898-23218, sequence of AAs 1-107

SEQ ID NO.: 139, U14, 5'→3' direction, 23316-25145, sequence of AAs 1-610

SEQ ID NO.: 140, U30, 5'→3' direction, 41884-45132, sequence of AAs 1-1083

SEQ ID NO.: 141, U31, 5'→3' direction, 45150-51383, sequence of AAs 1-2078

SEQ ID NO.: 142, U36, 5'→3' direction, 54252-55706, sequence of AAs 1-485

SEQ ID NO.: 143, U37, 5'→3' direction, 55710-56504, sequence of AAs 1-265

SEQ ID NO.: 144, U44, 5'→3' direction, 73446-74087, sequence of AAs 1-214

SEQ ID NO.: 145, U46, 5'→3' direction, 75291-75545, sequence of AAs 1-85

SEQ ID NO.: 146, U49, 5'→3' direction, 80277-81035, sequence of AAs 1-253

SEQ ID NO.: 147, U51, 5'→3' direction, 82574-83479, sequence of AAs 1-302

SEQ ID NO.: 148, U53, 5'→3' direction, 84281-85867, sequence of AAs 1-529

SEQ ID NO.: 149, U58, 5'→3' direction, 93924-96242, sequence of AAs 1-773

SEQ ID NO.: 150, U62, 5'→3' direction, 98427-98684, sequence of AAs 1-86

SEQ ID NO.: 151, U64, 5'→3' direction, 99260-100588, sequence of AAs 1-443

SEQ ID NO.: 152, U67, 5'→3' direction, 102458-103519, sequence of AAs 1-354

SEQ ID NO.: 153, U69, 5'→3' direction, 103866-105554, sequence of AAs 1-563

SEQ ID NO.: 154, U70, 5'→3' direction, 105562-107028, sequence of AAs 1-489

SEQ ID NO.: 155, U73, 5'→3' direction, 108325-110667, sequence of AAs 1-781

SEQ ID NO.: 156, U77, 5'→3' direction, 115100-117574, sequence of AAs 1-825

SEQ ID NO.: 157, U79, 5'→3' direction, 120164-121198, sequence of AAs 1-345

SEQ ID NO.: 158, U83, 5'→3' direction, 123528-123821, sequence of AAs 1-98

SEQ ID NO.: 159, U88, 5'→3' direction, 131034-132275, sequence of AAs 1-414

SEQ ID NO.: 160, putative protein U90, 5'→3' direction, 136266-136481, sequence of AAs 1-72

SEQ ID NO.: 161, U91, 5'→3' direction, 136485-136829, sequence of AAs 1-115

SEQ ID NO.: 162, U95, 5'→3' direction, 142941-146306, sequence of AAs 1-1122

SEQ ID NO.: 163, DR1, 5'→3' direction, 151734-152027, sequence of AAs 1-98

SEQ ID NO.: 164, DR4, 5'→3' direction, 153979-154281, sequence of AAs 1-101

SEQ ID NO.: 165, DR6, 5'→3' direction, 155958-156269, sequence of AAs 1-104

SEQ ID NO.: 166, DR7, 5'→3' direction, 156862-157953, sequence of AAs 1-364

SEQ ID NO.: 167, DR8, 5'→3' direction, 158470-158802, sequence of AAs 1-111

SEQ ID NO.: 168, DR2, 5'→3' direction, 791-2653, nucleic acid sequence encoding AAs 1-621

SEQ ID NO.: 169, DR2, 5'→3' direction, 791-2653, sequence of AAs 1-621

SEQ ID NO.: 170, U12 exon 1-2, 5'→3' direction, 21680-21710 and 21800-22812, nucleic acid sequence encoding AAs 1-348

SEQ ID NO.: 171, U12 exon 1-2, 5'→3' direction, 21680-21710 and 21800-22812, sequence of AAs 1-348

SEQ ID NO.: 172, U50, 5'→3' direction, 80812-82479, nucleic acid sequence encoding AAs 1-556

SEQ ID NO.: 173, U50, 5'→3' direction, 80812-82479, sequence of AAs 1-556

SEQ ID NO.: 174, U59, 5'→3' direction, 96239-97291, nucleic acid sequence encoding AAs 1-351

SEQ ID NO.: 175, U59, 5'→3' direction, 96239-97291, sequence of AAs 1-351

SEQ ID NO.: 176, U63, 5'→3' direction, 98632-99282, nucleic acid sequence encoding AAs 1-217

SEQ ID NO.: 177, U63, 5'→3' direction, 98632-99282, sequence of AAs 1-217

SEQ ID NO.: 178, U65, 5'→3' direction, 100545-101552, nucleic acid sequence encoding AAs 1-336

SEQ ID NO.: 179, U65, 5'→3' direction, 100545-101552, sequence of AAs 1-336

SEQ ID NO.: 180, U68, 5'→3' direction, 103519-103863, nucleic acid sequence encoding AAs 1-115

SEQ ID NO.: 181, U68, 5'→3' direction, 103519-103863, sequence of AAs 1-115

SEQ ID NO.: 182, U71, 5'→3' direction, 106965-107198, nucleic acid sequence encoding AAs 1-78

SEQ ID NO.: 183, U71, 5'→3' direction, 106965-107198, sequence of AAs 1-78

SEQ ID NO.: 184, U74, 5'→3' direction, 110636-112624, nucleic acid sequence encoding AAs 1-663

SEQ ID NO.: 185, U74, 5'→3' direction, 110636-112624, sequence of AAs 1-663

SEQ ID NO.: 186, U80, 5'→3' direction, 121170-121766, nucleic acid sequence encoding AAs 1-199

SEQ ID NO.: 187, U80, 5'→3' direction, 121170-121766, sequence of AAs 1-199

SEQ ID NO.: 188, DR2', 5'→3' direction, 152024-153886, nucleic acid sequence encoding AAs 1-621

SEQ ID NO.: 189, DR2', 5'→3' direction, 152024-153886, sequence of AAs 1-621

SEQ ID NO.: 190, genome sequence of strain U1102 (complementary strand)

SEQ ID NO.: 191, DR5, 3'→5' direction, 154967-155404, sequence of AAs 1-146

SEQ ID NO.: 192, DR3, 3'→5' direction, 153634-154212, sequence of AAs 1-193

SEQ ID NO.: 193, RJ1, 3'→5' direction, 151140-151571, sequence of AAs 1-144

SEQ ID NO.: 194, U100, 3'→5' direction, 149868-150437, sequence of AAs 1-190

SEQ ID NO.: 195, U99, 3'→5' direction, 149485-149766, sequence of AAs 1-94

SEQ ID NO.: 196, U98, 3'→5' direction, 148741-149391, sequence of AAs 1-217

SEQ ID NO.: 197, U97, 3'→5' direction, 147808-148077, sequence of AAs 1-90

SEQ ID NO.: 198, U96, 3'→5' direction, 146641-146940, sequence of AAs 1-100

SEQ ID NO.: 199, U94, 3'→5' direction, 141394-142866, sequence of AAs 1-491

SEQ ID NO.: 200, U93, 3'→5' direction, 138531-139124, sequence of AAs 1-198

SEQ ID NO.: 201, U92, 3'→5' direction, 138049-138492, sequence of AAs 1-148

SEQ ID NO.: 202, U90, 3'→5' direction, 135664-135948, sequence of AAs 1-95

SEQ ID NO.: 203, U89, 3'→5' direction, 133091-135610, sequence of AAs 1-840

SEQ ID NO.: 204, U86, 3'→5' direction, 125989-128136, sequence of AAs 1-716

SEQ ID NO.: 205, U85, 3'→5' direction, 124981-125853, sequence of AAs 1-291

SEQ ID NO.: 206, U84, 3'→5' direction, 123925-124953, sequence of AAs 1-343

SEQ ID NO.: 207, U82, 3'→5' direction, 122653-123405, sequence of AAs 1-251

SEQ ID NO.: 208, U81, 3'→5' direction, 121810-122577, sequence of AAs 1-256

SEQ ID NO.: 209, U78, 3'→5' direction, 118709-119038, sequence of AAs 1-110

SEQ ID NO.: 210, U75, 3'→5' direction, 112659-113408, sequence of AAs 1-250

SEQ ID NO.: 211, U72, 3'→5' direction, 107278-108312, sequence of AAs 1-345

SEQ ID NO.: 212, U66, 3'→5' direction, 101569-102486, sequence of AAs 1-306

SEQ ID NO.: 213, U60, 3'→5' direction, 97288-98256, sequence of AAs 1-323

SEQ ID NO.: 214, U57, 3'→5' direction, 89875-93912, sequence of AAs 1-1346

SEQ ID NO.: 215, U56, 3'→5' direction, 88983-89873, sequence of AAs 1-297

SEQ ID NO.: 216, U55, 3'→5' direction, 87505-88803, sequence of AAs 1-433

SEQ ID NO.: 217, U54, 3'→5' direction, 86051-87427, sequence of AAs 1-459

SEQ ID NO.: 218, U52, 3'→5' direction, 83498-84274, sequence of AAs 1-259

SEQ ID NO.: 219, U48, 3'→5' direction, 78034-80118, sequence of AAs 1-695

SEQ ID NO.: 220, U47, 3'→5' direction, 75912-77867, sequence of AAs 1-652

SEQ ID NO.: 221, U45, 3'→5' direction, 74088-75218, sequence of AAs 1-377

SEQ ID NO.: 222, U43, 3'→5' direction, 70823-73405, sequence of AAs 1-861

SEQ ID NO.: 223, U42, 3'→5' direction, 69054-70598, sequence of AAs 1-515

SEQ ID NO.: 224, U41, 3'→5' direction, 64222-67620, sequence of AAs 1-1133

SEQ ID NO.: 225, U40, 3'→5' direction, 62034-64214, sequence of AAs 1-727

SEQ ID NO.: 226, U38, 3'→5' direction, 56550-59588, sequence of AAs 1-1013

SEQ ID NO.: 227, U35, 3'→5' direction, 53933-54253, sequence of AAs 1-107

SEQ ID NO.: 228, U33, 3'→5' direction, 51723-53135, sequence of AAs 1-471

SEQ ID NO.: 229, U32, 3'→5' direction, 51455-51721, sequence of AAs 1-89

SEQ ID NO.: 230, U29, 3'→5' direction, 41457-42356, sequence of AAs 1-300

SEQ ID NO.: 231, U28, 3'→5' direction, 39020-41434, sequence of AAs 1-805

SEQ ID NO.: 232, U26, 3'→5' direction, 36922-37809, sequence of AAs 1-296

SEQ ID NO.: 233, U25, 3'→5' direction, 35864-36814, sequence of AAs 1-317

SEQ ID NO.: 234, Unknown 1, 3'→5' direction, 35674-35847, sequence of AAs 1-58

SEQ ID NO.: 235, U24, 3'→5' direction, 35392-35655, sequence of AAs 1-88

SEQ ID NO.: 236, U23, 3'→5' direction, 34375-35085, sequence of AAs 1-237

SEQ ID NO.: 237, U22, 3'→5' direction, 33739-34347, sequence of AAs 1-203

SEQ ID NO.: 238, U21, 3'→5' direction, 32340-33641, sequence of AAs 1-434

SEQ ID NO.: 239, U20, 3'→5' direction, 31069-32337, sequence of AAs 1-423

SEQ ID NO.: 240, U19, 3'→5' direction, 29649-30818, sequence of AAs 1-390

SEQ ID NO.: 241, U18, 3'→5' direction, 28508-29389, sequence of AAs 1-294

SEQ ID NO.: 242, U16, 3'→5' direction, 26259-27116, sequence of AAs 1-286

SEQ ID NO.: 243, U15, 3'→5' direction, 25660-25992, sequence of AAs 1-111

SEQ ID NO.: 244, U11, 3'→5' direction, 18966-21578, sequence of AAs 1-871

SEQ ID NO.: 245, U9, 3'→5' direction, 17238-17552, sequence of AAs 1-105

SEQ ID NO.: 246, U8, 3'→5' direction, 16021-17091, sequence of AAs 1-357

SEQ ID NO.: 247, U7, 3'→5' direction, 14908-15936, sequence of AAs 1-343

SEQ ID NO.: 248, U5, 3'→5' direction, 13214-14548, sequence of AAs 1-445

SEQ ID NO.: 249, U4, 3'→5' direction, 11485-13092, sequence of AAs 1-536

SEQ ID NO.: 250, U3, 3'→5' direction, 10155-11276, sequence of AAs 1-374

SEQ ID NO.: 251, U2, 3'→5' direction, 8716-9816, sequence of AAs 1-367

SEQ ID NO.: 252, LJ1, 3'→5' direction, 7467-8432, sequence of AAs 1-322

SEQ ID NO.: 253, DR5, 3'→5' direction, 3734-4171, sequence of AAs 1-146

SEQ ID NO.: 254, DR3, 3'→5' direction, 2401-2979, sequence of AAs 1-193

SEQ ID NO.: 255, LT1, 3'→5' direction, 1-338, sequence of AAs 1-113

SEQ ID NO.: 256, U16 exon 1-2, 3'→5' direction, 26259-27034 and 27187-27349, nucleic acid sequence encoding AAs 1-313

SEQ ID NO.: 257, U16 exon 1-2, 3'→5' direction, 26259-27034 and 27187-27349, sequence of AAs 1-313

SEQ ID NO.: 258, U17, 3'→5' direction, 26948-27349, nucleic acid sequence encoding AAs 1-134

SEQ ID NO.: 259, U17, 3'→5' direction, 26948-27349, sequence of AAs 1-134

SEQ ID NO.: 260, U39, 3'→5' direction, 59588-62080, nucleic acid sequence encoding AAs 1-831

SEQ ID NO.: 261, U39, 3'→5' direction, 59588-62080, sequence of AAs 1-831

SEQ ID NO.: 262, U34, 3'→5' direction, 53086-53916, nucleic acid sequence encoding AAs SEQ ID NO.: 263, U34, 3'→5' direction, 53086-53916, sequence of AAs 1-277

SEQ ID NO.: 264, U27, 3'→5' direction, 37797-38978, nucleic acid sequence encoding AAs 1-394

SEQ ID NO.: 265, U27, 3'→5' direction, 37797-38978, sequence of AAs 1-394

SEQ ID NO.: 266, U61, 3'→5' direction, 98231-98578, nucleic acid sequence encoding AAs 1-116

SEQ ID NO.: 267, U61, 3'→5' direction, 98231-98578, sequence of AAs 1-116

SEQ ID NO.: 268, U76, 3'→5' direction, 113317-115305, nucleic acid sequence encoding AAs 1-663

SEQ ID NO.: 269, U76, 3'→5' direction, 113317-115305, sequence of AAs 1-663

SEQ ID NO.: 270, U87, 3'→5' direction, 127551-130043, nucleic acid sequence encoding AAs 1-831

SEQ ID NO.: 271, U87, 3'→5' direction, 127551-130043, sequence of AAs 1-831

SEQ ID NO.: 272, genome sequence of strain HST

SEQ ID NO.: 273, DR1, 5'→3' direction, 576-842, sequence of AAs 1-89

SEQ ID NO.: 274, DR2, 5'→3' direction, 1027-2970, sequence of AAs 1-648

SEQ ID NO.: 275, DR6, 5'→3' direction, 5025-5336, sequence of AAs 1-104

SEQ ID NO.: 276, DR7, 5'→3' direction, 6512-7150, sequence of AAs 1-213

SEQ ID NO.: 277, D, 5'→3' direction, 7928-8662, sequence of AAs 1-245

SEQ ID NO.: 278, U1, 5'→3' direction, 8929-9384, sequence of AAs 1-152

SEQ ID NO.: 279, U6, 5'→3' direction, 15395-15652, sequence of AAs 1-86

SEQ ID NO.: 280, U10, 5'→3' direction, 18386-19897, sequence of AAs 1-504

SEQ ID NO.: 281, U13, 5'→3' direction, 23699-24022, sequence of AAs 1-108

SEQ ID NO.: 282, U14, 5'→3' direction, 24136-25953, sequence of AAs 1-606

SEQ ID NO.: 283, U30, 5'→3' direction, 42839-46087, sequence of AAs 1-1083

SEQ ID NO.: 284, U31, 5'→3' direction, 46105-52338, sequence of AAs 1-2078

SEQ ID NO.: 285, U36, 5'→3' direction, 55212-56660, sequence of AAs 1-483

SEQ ID NO.: 286, U37, 5'→3' direction, 56664-57458, sequence of AAs 1-265

SEQ ID NO.: 287, U44, 5'→3' direction, 74335-75030, sequence of AAs 1-232

SEQ ID NO.: 288, U46, 5'→3' direction, 76180-76434, sequence of AAs 1-85

SEQ ID NO.: 289, U49, 5'→3' direction, 81342-82100, sequence of AAs 1-253

SEQ ID NO.: 290, U51, 5'→3' direction, 83642-84547, sequence of AAs 1-302

SEQ ID NO.: 291, U53, 5'→3' direction, 85350-86936, sequence of AAs 1-529

SEQ ID NO.: 292, U58, 5'→3' direction, 95048-97366, sequence of AAs 1-773

SEQ ID NO.: 293, U59, 5'→3' direction, 97375-98415, sequence of AAs 1-347

SEQ ID NO.: 294, U62, 5'→3' direction, 99551-99814, sequence of AAs 1-88

SEQ ID NO.: 295, U64, 5'→3' direction, 100390-101718, sequence of AAs 1-443

SEQ ID NO.: 296, U67, 5'→3' direction, 103591-104652, sequence of AAs 1-354

SEQ ID NO.: 297, U69, 5'→3' direction, 104999-106690, sequence of AAs 1-564

SEQ ID NO.: 298, U70, 5'→3' direction, 106698-108164, sequence of AAs 1-489

SEQ ID NO.: 299, U73, 5'→3' direction, 109475-111817, sequence of AAs 1-781

SEQ ID NO.: 300, U77, 5'→3' direction, 116250-118724, sequence of AAs 1-825

SEQ ID NO.: 301, U79, 5'→3' direction, 121322-122359, sequence of AAs 1-346

SEQ ID NO.: 302, U80, 5'→3' direction, 122640-122942, sequence of AAs 1-101

SEQ ID NO.: 303, U83, 5'→3' direction, 124657-124998, sequence of AAs 1-114

SEQ ID NO.: 304, U91, 5'→3' direction, 138630-138974, sequence of AAs 1-115

SEQ ID NO.: 305, U95, 5'→3' direction, 144230-147868, sequence of AAs 1-1213

SEQ ID NO.: 306, DR1R, 5'→3' direction, 153618-153884, sequence of AAs 1-89

SEQ ID NO.: 307, DR2R, 5'→3' direction, 154069-156012, sequence of AAs 1-648

SEQ ID NO.: 308, DR6R, 5'→3' direction, 158067-158378, sequence of AAs 1-104

SEQ ID NO.: 309, DR7R, 5'→3' direction, 159554-160192, sequence of AAs 1-213

SEQ ID NO.: 310, U12, 5'→3' direction, 22479-22511 and 22589-23617, nucleic acid sequence encoding AAs 1-354

SEQ ID NO.: 311, U12, 5'→3' direction, 22479-22511 and 22589-23617, sequence of AAs 1-354

SEQ ID NO.: 312, U50, 5'→3' direction, 81877-83544, nucleic acid sequence encoding AAs 1-556

SEQ ID NO.: 313, U50, 5'→3' direction, 81877-83544, sequence of AAs 1-556

SEQ ID NO.: 314, U63, 5'→3' direction, 99756-100412, nucleic acid sequence encoding AAs 1-219

SEQ ID NO.: 315, U63, 5'→3' direction, 99756-100412, sequence of AAs 1-219

SEQ ID NO.: 316, U65, 5'→3' direction, 101675-102682, nucleic acid sequence encoding AAs 1-336

SEQ ID NO.: 317, U65, 5'→3' direction, 101675-102682, sequence of AAs 1-336

SEQ ID NO.: 318, U68, 5'→3' direction, 104652-104996, nucleic acid sequence encoding AAs 1-115

SEQ ID NO.: 319, U68, 5'→3' direction, 104652-104996, sequence of AAs 1-115

SEQ ID NO.: 320, U71, 5'→3' direction, 108101-108346, nucleic acid sequence encoding AAs SEQ ID NO.: 321, U71, 5'→3' direction, 108101-108346, sequence of AAs 1-82

SEQ ID NO.: 322, U74, 5'→3' direction, 111786-113774, nucleic acid sequence encoding AAs 1-663

SEQ ID NO.: 323, U74, 5'→3' direction, 111786-113774, sequence of AAs 1-663

SEQ ID NO.: 324, genome sequence (complementary strand) of strain HST

SEQ ID NO.: 325, DRHN2R, 3'→5' direction, 160278-160748, sequence of AAs 1-157

SEQ ID NO.: 326, DRHN1R, 3'→5' direction, 158065-158574, sequence of AAs 1-170

SEQ ID NO.: 327, DR3R, 3'→5' direction, 155760-156362, sequence of AAs 1-201

SEQ ID NO.: 328, RJ1, 3'→5' direction, 153060-153407, sequence of AAs 1-116

SEQ ID NO.: 329, U100, 3'→5' direction, 151529-151918, sequence of AAs 1-130

SEQ ID NO.: 330, U99, 3'→5' direction, 151115-151396, sequence of AAs 1-94

SEQ ID NO.: 331, U98, 3'→5' direction, 150376-150870, sequence of AAs 1-165

SEQ ID NO.: 332, HN2, 3'→5' direction, 149749-149913, sequence of AAs 1-55

SEQ ID NO.: 333, U97, 3'→5' direction, 149352-149651, sequence of AAs 1-100

SEQ ID NO.: 334, U94, 3'→5' direction, 142683-144155, sequence of AAs 1-491

SEQ ID NO.: 335, HN1, 3'→5' direction, 141543-142355, sequence of AAs 1-271

SEQ ID NO.: 336, U90, 3'→5' direction, 137810-138085, sequence of AAs 1-92

SEQ ID NO.: 337, U89, 3'→5' direction, 134808-137684, sequence of AAs 1-959

SEQ ID NO.: 338, U86, 3'→5' direction, 127176-131717, sequence of AAs 1-1514

SEQ ID NO.: 339, U85, 3'→5' direction, 126160-127038, sequence of AAs 1-293

SEQ ID NO.: 340, U84, 3'→5' direction, 125104-126132, sequence of AAs 1-343

SEQ ID NO.: 341, U82, 3'→5' direction, 123829-124581, sequence of AAs 1-251

SEQ ID NO.: 342, U81, 3'→5' direction, 122986-123753, sequence of AAs 1-256

SEQ ID NO.: 343, U76, 3'→5' direction, 114467-116455, sequence of AAs 1-663

SEQ ID NO.: 344, U75, 3'→5' direction, 113379-113756, sequence of AAs 1-126

SEQ ID NO.: 345, U72, 3'→5' direction, 108428-109462, sequence of AAs 1-345

SEQ ID NO.: 346, U66, 3'→5' direction, 102702-103619, sequence of AAs 1-306

SEQ ID NO.: 347, U60, 3'→5' direction, 98412-99380, sequence of AAs 1-323

SEQ ID NO.: 348, U57, 3'→5' direction, 90999-95036, sequence of AAs 1-1346

SEQ ID NO.: 349, U56, 3'→5' direction, 90107-90997, sequence of AAs 1-297

SEQ ID NO.: 350, U55, 3'→5' direction, 88628-90106, sequence of AAs 1-493

SEQ ID NO.: 351, U54, 3'→5' direction, 87171-88550, sequence of AAs 1-460

SEQ ID NO.: 352, U52, 3'→5' direction, 84744-85343, sequence of AAs 1-200

SEQ ID NO.: 353, U48, 3'→5' direction, 79099-81183, sequence of AAs 1-695

SEQ ID NO.: 354, U47, 3'→5' direction, 76617-78833, sequence of AAs 1-739

SEQ ID NO.: 355, U45, 3'→5' direction, 74977-76107, sequence of AAs 1-377

SEQ ID NO.: 356, U43, 3'→5' direction, 71712-74294, sequence of AAs 1-861

SEQ ID NO.: 357, U42, 3'→5' direction, 69937-71487, sequence of AAs 1-517

SEQ ID NO.: 358, U41, 3'→5' direction, 65176-68574, sequence of AAs 1-1133

SEQ ID NO.: 359, U40, 3'→5' direction, 62988-65168, sequence of AAs 1-727

SEQ ID NO.: 360, U38, 3'→5' direction, 57504-60542, sequence of AAs 1-1013

SEQ ID NO.: 361, U35, 3'→5' direction, 54893-55210, sequence of AAs 1-106

SEQ ID NO.: 362, U33, 3'→5' direction, 52683-54095, sequence of AAs 1-471

SEQ ID NO.: 363, U32, 3'→5' direction, 52412-52681, sequence of AAs 1-90

SEQ ID NO.: 364, U29, 3'→5' direction, 42412-43311, sequence of AAs 1-300

SEQ ID NO.: 365, U28, 3'→5' direction, 39975-42389, sequence of AAs 1-805

SEQ ID NO.: 366, U26, 3'→5' direction, 37883-38770, sequence of AAs 1-296

SEQ ID NO.: 367, U25, 3'→5' direction, 36825-37775, sequence of AAs 1-317

SEQ ID NO.: 368, U24, 3'→5' direction, 36350-36616, sequence of AAs 1-89

SEQ ID NO.: 369, U23, 3'→5' direction, 35326-36225, sequence of AAs 1-300

SEQ ID NO.: 370, U21, 3'→5' direction, 33291-34793, sequence of AAs 1-501

SEQ ID NO.: 371, U20, 3'→5' direction, 31984-33288, sequence of AAs 1-435

SEQ ID NO.: 372, U19, 3'→5' direction, 30592-31761, sequence of AAs 1-390

SEQ ID NO.: 373, U18, 3'→5' direction, 29443-30327, sequence of AAs 1-295

SEQ ID NO.: 374, U17, 3'→5' direction, 28003-28263, sequence of AAs 1-87

SEQ ID NO.: 375, U16, 3'→5' direction, 27172-27603, sequence of AAs 1-144

SEQ ID NO.: 376, U15, 3'→5' direction, 26559-26891, sequence of AAs 1-111

SEQ ID NO.: 377, U11, 3'→5' direction, 19801-22377, sequence of AAs 1-859

SEQ ID NO.: 378, U8, 3'→5' direction, 16806-18041, sequence of AAs 1-412

SEQ ID NO.: 379, U7, 3'→5' direction, 15678-16802, sequence of AAs 1-375

SEQ ID NO.: 380, U5, 3'→5' direction, 14002-15333, sequence of AAs 1-444

SEQ ID NO.: 381, U4, 3'→5' direction, 12276-13883, sequence of AAs 1-536

SEQ ID NO.: 382, U3, 3'→5' direction, 10891-12051, sequence of AAs 1-387

SEQ ID NO.: 383, U2, 3'→5' direction, 9467-10768, sequence of AAs 1-434

SEQ ID NO.: 384, LJ1, 3'→5' direction, 8292-8807, sequence of AAs 1-172

SEQ ID NO.: 385, DRHN2, 3'→5' direction, 7236-7706, sequence of AAs 1-157

SEQ ID NO.: 386, DRHN1, 3'→5' direction, 5023-5532, sequence of AAs 1-170

SEQ ID NO.: 387, DR3, 3'→5' direction, 2718-3320, sequence of AAs 1-201

SEQ ID NO.: 388, LT1, 3'→5' direction, 18-365, sequence of AAs 1-116

SEQ ID NO.: 389, U9, 3'→5' direction, 18022-18336, nucleic acid sequence encoding AAs 1-105

SEQ ID NO.: 390, U9, 3'→5' direction, 18022-18336, sequence of AAs 1-105

SEQ ID NO.: 391, U22, 3'→5' direction, 34690-35298, nucleic acid sequence encoding AAs 1-203

SEQ ID NO.: 392, U22, 3'→5' direction, 34690-35298, sequence of AAs 1-203

SEQ ID NO.: 393, U27, 3'→5' direction, 38758-39933, nucleic acid sequence encoding AAs 1-392

SEQ ID NO.: 394, U27, 3'→5' direction, 38758-39933, sequence of AAs 1-392

SEQ ID NO.: 395, U34, 3'→5' direction, 54046-54876, nucleic acid sequence encoding AAs 1-277

SEQ ID NO.: 396, U34, 3'→5' direction, 54046-54876, sequence of AAs 1-277

SEQ ID NO.: 397, U39, 3'→5' direction, 60542-63034, nucleic acid sequence encoding AAs 1-831

SEQ ID NO.: 398, U39, 3'→5' direction, 60542-63034, sequence of AAs 1-831

SEQ ID NO.: 399, U61, 3'→5' direction, 99355-99867, nucleic acid sequence encoding AAs 1-171

SEQ ID NO.: 400, U61, 3'→5' direction, 99355-99867, sequence of AAs 1-171

SEQ ID NO.: 401, BAC vector sequence

SEQ ID NO.: 402, primer BAC7-E1

SEQ ID NO.: 403, primer BAC7-E2

SEQ ID NO.: 404, primer BAC7-E3

SEQ ID NO.: 405, primer BAC7-E4

SEQUENCE LISTING (405 sequences)

SEQ ID NO: 1 - DNA, 144861 bp, herpes simplex virus 7
  CDS (33)..(542)
  CDS (898)..(2100)
  CDS (2267)..(2506)
  CDS (2562)..(3050)
  CDS (3122)..(3910)
  CDS (14608)..(15963)
  CDS (18396)..(19436)
  CDS (19521)..(19817)
  CDS (19885)..(21831)
  CDS (24318)..(24587)
  CDS (37362)..(40178)
  CDS (40179)..(46358)
  CDS (49118)..(50575)
  CDS (50577)..(51356)
  CDS (67143)..(67754)
  CDS (68930)..(69190)
  CDS (73003)..(73722)
  CDS (75304)..(76188)
  CDS (76957)..(78495)
  CDS (87563)..(89890)
  CDS (92017)..(92244)
  CDS (92829)..(94148)
  CDS (95984)..(97024)
  CDS (97371)..(99011)
  CDS (99013)..(100455)
  CDS (101693)..(104056)
  CDS (108435)..(110897)
  CDS (112811)..(113311)
  CDS (113502)..(114203)
  CDS (114257)..(114505)
  CDS (114557)..(115189)
  CDS (129122)..(129625)
  CDS (130829)..(132112)
  CDS (133382)..(136204)
  CDS (139080)..(139589)
  CDS (139945)..(141147)
  CDS (141314)..(141553)
  CDS (141609)..(142097)
  CDS (142169)..(142957)
cccccccgtttcgtatttcaaatcctaaataacccccggggggtaaaaaaagggggggagctaaccctaaccctaaccctaaccctagctctaagcctaaccccagccctaaccctaaccctagctctaagcctaaccccaaccctaaccctagctctcactgtcaccctaacactagctccaagtcatctgttctagatcctatccatatctgccctgactcctggttccttaccgctccgagccccaccctccgtcccgccctcctcctgttctccatgccctgccttctcaacccttcctcttccacgcccacattgcctctgcactccgcgctctcttggctgtgcgccctgcctttccgtgacctactgggagcgccgccaaatctgttttgccccgcccctgcgcgcgcgggaactgtcggcgccgcgctgctgctagcccgccttccagagctccctccctccgtctgcctcctcacccttgccactcacccttccatctcttctatcacagactctgtgttacaccacctatgactgctgcaaccacagaacattttgctctccgcgcggcactcaatcgttactggtggctgcttctgggacgacacaagctcagtttggtatgcaactacgtcacagctcatcgccaacagttactgccgctgccgtggcccgaacaggaatttctccaacttgacccggccccctactccaatctccgcaaccgtgtcgctcaccatctccatcgcggctggccagcggcacacaacacatgtaagctaccgtacatctctttcacaaacccagggctcacatagagacaagcacaagctcgcgcaatgacattaaaacctcccatcattgtcctttcctgtcgctttgccgataacgtctttgctctatcgcaggtttcgacccccgtccttacttccccaatgctaaagtcaagctgcttccgctcggctccatcacccttaccagatcattctccagtgacgagcctcatcctattggtgatgatgtgcatcacagtcatgaccggggtgactaccatactgttatctgcagctggctcacaggaacctccccgatcctagtgctgcttcaaggaccggacggcagcatctattgccacgacgtgtaccgcggccgattgtatctcgtggcccactctgtatcgttgttcgccaggctaggccttcgccactgcgaacctttatatgcggcacccagatggaagcacgttcctctgcccaacatgtgggtggcgagcccgccagcgtccgccaccctcacgcaaacactcgccgtgagtgccacgcacggtctggacgcgttatactcgctgctaaaaatccacagaggaactccgtgttcgctaatccaccccgtgaacggctacgtcctggacatgatactgacgggccgctcattccaagaagcaccctgccaaaacactcgcacgtccgttaaaacaacgccacatgtaatggacgcagtctgcggtggccgcgggtcatggctgtccatcggctacctagtaaagatgccgcacattcacctggcggtgacccgaacatgtctggtcaccgccatagatgtccgacaaaactttctgtggcgcgtggcggacgacgcgctgctattcctggtcaccggtagtcttttactactgtcgcggccgaccgcagacttgacgtcttggtcatgtttacagcaagaacctgtgtggaggaactgtctagatacgcgcggagaacaggatgagacagaagaccaagagatgaaacaaagcacaagcaaaaagcaaaatgagaataaaaaactcaacacctcaaaaaaacacacccgcgtatcgtcggcaattccgacctttcccctcagtctccgagaaacgccgccagaagccaggagcccagccgtcctcgccgccgccacccagtctcacaaaactcgagcgatctcgacgcataatgccacgacaacaataagaataccgcgccttcccagttacctgctggaagcgcgtctcttgtccgtgacagctatcctgaaagacacaaagaaaaaaaaaacccagcctcaggcgtagcagctgcgacgtcagcgcggtgtctgaaagctcgccaaggtctcgcgtaaaagaacagatgtgaacttcagatgtaccaaccaaataatacgggttccgctataaaaagtgcacctctattcccgttcttatccccgttctaactcttccttgtatcataccttgcatgttaaccggatcccgtggatcttacacacatacacacacacacaaacttggtgaggtaaacacagagatctcactaactcataatcccctacacgcttaccaccacctaaaaatggttacaaccaaaactggcaatagtctatcttctttttctttccattcacagccaatgtgcagtactcgtgggtccacaacaacgaaagagactgtagagacagttcctttaagtagaccttagagacacaccaaatacaaccacaaccaaaaaaaaaacagaaaacaacacaaagccaatgagtgcagaaatgctccgcgctgttcagctccagccaagacgccggggacattcctcatctcccacttcccctccactcgaaggagagcccagtcccaagagactccaatcgagcgacagtcaccaagggcgtagaggcagacctaaacccagagctaaaacatggagcgaagctttatcccaccggtccttcctcaacatttacgcgtggctgtctttgagtcgagggtctccgcgaaaagtgtacggatatgccttcaggcacagaggagaactcgtagcattgccatggccgcctaactggagcctggaacttcaccacgatccctatcgagacgccagagcacaaaccgtttggagtcaccgctggggatggcctgcaacacacgtgacagctcgcacggtgcgggactgcggtgagtgtaagcagtgtgacacattgttatcgcaattgtcttacccgattaactttttattaatgtattaagcactctttcttcacgtgtgactgttgtgttttttgttgttatctacatcccggcagccctcgacacgcatatgtacgtgtgctgcggacgcggagaaaagttgcagcccgtcggatacgtacgcaacagagccgcgccttcagacctgaactcgttacgcgtcctcctcatagccagggacggagcaatgtatgtgcatcacatgagaacggcgcgactgtgccgcctggccagcagtgtgaccgaattcgcgcgacgagggctgcagcgagaatccgaggtttatgaagatgatgtttccttgccagaccgtcgagtaggttcggcaacggccattcacctgtttgacgtaattacccaggcagccgatgtccacgacctactcaccgtggccggactgtgtcagactcacaccggcgtcagctgccaactgtggtatacagaccacgatccccacaccgtcgctggggcggcacgcttcacactgacggtcgcacggcagcagtatcgattgtggccaaacgcacgacgcaaactgctgcagcacctacatccggaccacccacttgggctgtggctgttgtgtgccgtgctcacgtacgatgcaaaagagacgaatcgcgcagtgccacccgtaacgccaggggccgaaaccgtgtgggtgatagttactggcaggggtgccattctaggattctggccagagagcgccaaaatgtgcagattggcctcgtctatgaaaggactctggaaaaacggagcgcgggcgctaaaaggtcactggacatacgcagcacccggccggcatagagcgggagaggcctggcctttgtgtgcacactaccaatctcctagatagaacaaaattaaaaagattaaaaaaaaaagaaaaaaagtacaagagtgttatcgcgaaacagcgtgtcaaaaaaaaaacaatccacatactctagaacaaactgtacccaaaaataagtccgtgtgcaaaactgggaaaaaaaaatcaccttcctcgttgccactagagggagtaccgaaagtgtaggcaagaaggccacgctgtaaatgactgtcagcgtttggcgctgaaaacattgctgttcttgctggctcaagcacaatcacgtgattaagattcctttcgttttcaaagtgtgcccgggaggcagacatgccctttctcgtgagacattatgagatttgcctgccagagaaccacgtgacttggacttactttcgttttctaaacgtgccctctaggcatgaatgctctttagcgttagccatgaggctagcgtgatcctgtatagtacataagtttctaagaatatgtttttaacaataatcatgtcccaaaaagtcgcgagtgactaaaattctctgtaaatgaaggcaaattaaacaggatacagacagttgtggcagtggtccgtttcgtctttctgtgttttccttacgcggctgacgaggtaaagtgtctcagtccatattgttgtctgtgccaccgtagttagcggtggcatactaaaaactccgatagatgcagaacaataacaccgaaaaccacgctgtggaaccagaccacactttataaacaaaacggccttatcacctggaaaaaaaactaaaaataaggcaatgatacacctgactttccattggaaacctgccgtaaccctgaccacaaatcccatgctaaatcccctgaaacactgccaaacgtcgctacaaggtttttccgggatcgagccgcagcaagcttaaactgaggtcacacacgactttaattacggcaacgcacagctgtaagctgcaggaaagatacgatcgtaagcaaatgtagtcctacaatcaagcgaggttgtagacgttacctacaatgaactacacctctaagcataacctgtcgggcacagtgagacacgcagccgtaaattcaaaactcaacccaaaccgaagtctaagtctcaccctaatcgtaacagtaaccctacaactctaatcctagtccgtaaccgtaaccccaatcctagcccttagccctaaccctagccctaaccctagctctaaccttagctctaactctgaccctaggcctaaccctaagcctaaccctaaccgtagctctaagtttaaccctaaccctaaccctaaccatgaccctgaccctaaccctaggctgcggccctaaccctagccctaaccctaaccctaatcctaatcctagccctaaccctagggctgcggccctaaccctagccctaaccctaaccctaaccctagggctgcggccctaaccctaaccctagggctgcggcccgaaccctaaccctaaccctaaccctaaccctagggctgcggccctaaccctaaccctagggctgcggccctaaccctaaccctagggctgcggcccgaaccctaaccctaaccctaaccctagggctgcggccctaaccctaaccctagggctgcggccctaaccctaaccctaactctagggctgcggccctaaccctaaccctaaccctaaccctagggctgcggcccgaaccctagccctaaccctaaccctgaccctgaccctaaccctaaccctaaccctaaccctaaccctaaccctaaccctaaccctaaccctaaccctaaccctaaccctaaccctaaccctaaccctaaccccgcccccactggcagccaatgtcttgtaatgccttcaaggcactttttctgcgagccgcgcgcagcactcagtgaaaaacaagtttgtgcacgagaaagacgctgccaaaccgcagctgcagcatgaaggctgagtgcacaattttggctttagtcccataaaggcgcggcttcccgtagagtagaaaaccgcagcgcggcgcacagagcgaaggcagcggctttcagactgtttgccaagcgcagtctgcatcttaccaatgatgatcgcaagcaagaaaaatgttctttcttagcatatgcgtggttaatcctgttgtggtcatcactaagttttcaagcttttggcaaggcatgaaaaataacattactattggactgtttatacttatcttcaaatgttcactcacagcagcgaaggggacactagaaaacactcccaagtagaactacgaggcggaacagcaatggaaactcagacgtgtttttacttttattttctgaaatcatttaatagcatacaagtacggcctctccgaatcgaagctaatctgagagcaaagacaaagagcactgtaagactgaaggcaaaaaaaccccccgcttaaaaaagaatttcataattccgcagctcttccgaagccccccgagaacaacacagatcgctaagggtgtctggactgagctcagtatcccggtaagcctccagagcagatggacataaactatattctcgtggtaattgaactaccggaacgtggatgcaagtgacgggtaactgcatggcccaagcgtttctatcaggaaagcgatagtttttaaagagtctcctggcgcccatggccaaaaaaaccctaaaactacaagccaagctaacgacggctcctccgcgaacatccagagcgtagacagcacccaagcgatccataagaacccgttgctttcgaagaagaccacgaccgaggcatcttccgacaaactttccgataaccacggcaacgccacgcctaggaatgaacctccaccgctctccatggtcctccgggacggaaaattcgaacagcacgcctttaggccacggaagaggcacaagagccttgtcgaaagcaacagcgaaattcaaaacatcctccaccccgcacatagggccgaagaaaaaaccccccgaaacgatggactcgaaaaaagcgtacacagggtcaaatctgcgcagaccacgcttccagagaccataaggggtgtccgcaactctgtaaatggcgttgtccacggaacggttaaatgcataaaattcaccccgatctccaataagcatcaaagcagataaatcagaatagagcaccagaccgatgacccaaacatccacaaaaggacaacagacaaaatttctggttaacttgcagacttcgtcttccgaaatgccaagcatctccgaagaggcaaacctcaactcagcgccggaaggccacacgagaggaagtcgatggtgagcatattgcaaaacaaaatgagcaacgtctccgaaagatacggtttccgcagcgaagctctgcaaaaacgtggtccagtagacctccggaacaggtgattcaactgtattcgattccagattaaacaaaccgttcgatgcattcgactcaacagccgtttccacaccggaatccaaaagcggagaatctgacatactagcaacatgcaaatgatcagagaaaaaaaacaagtgaaatgcacagagacaaatacaatcaaactcatactctaaagcacgaacgctgtttattaattaccatgtcaatttcaaaacccaccagcaaacaaggcaataaaaaaaaagagtcacaaacttagcaacgaaaaatctgggttccaacatcaggaaacgctgcccgctcatctgctcttgcagccaagaagagaaggtcacagtcgccctgtctggcagttttcagataaaagcgcgacgaaaaatgacacaatggtttctggcaccatttgggctgagccgcgtaaaaagtgtgatgtttatagaagttacgcacaccgacaaacctaaaaacctgaaaactctctgcgatgaaagtcaagtttccgtcgggatcgttatcattaaacccataaatttttcccgagcagtcagcgtaaagggaaattctagctccgtctgaaaaacatttcagtccgaagctcgcaaagaaacacatatcagctaaaacactttttatctccgggtcagaaacaaaatgaaaactgtctttcctgtgatgaaacaggatattctctctcgccggccatcgcaactcaaatttttcaccaagatgcctgtcccgaaatgccaaaatttcagcgcatgttgtgatagcttcaatctctggatctgatacctcaaattgcagacacttacacaaaacgtatgcgtacagacatcttttgagacctttcctcaaaaaactgtcaatagtgtcacccacgcgacatagttgatcaggaaataacgttgtatgtgcataaacgcggccaactttcccaagtaagataaccacatcatcagtctcatactcaagttcgtaaacagtcgtcacagtatgttttatgtaaccaagaacagtaagttcttcaggacaacacaccaacgcggcgtactttttgagcttatcttcctcatatccctccacaccataagtcaaaacaagttcaaacccctctggaaaaaccaaaggcaccctcaaatgcggattcagaaacaaaaacatttttagactattaaaatttgtataaacacgtagaaaatccacgagtttagccttagcagattcaaagattttctcttttctttttttatcagataaaaacgttttctcaacgttggcaaccttcaaatcctttttcccgtcaacatgagcaacatattttcgtataaacgaattttccttttttaaatcttttgccacaactctcaaaacacgctcttcaaaattgaagtcagaccccaaatctgccatacttaaatcgtacctagcgtattaataatctttgtgcaccggtttcgcaaaagggcagaaagccaaccgcggaatgcgacgcgactggcgaatggtaaatccgcggtgctgagactctttaaaaagccttttcctcaccgaaactctcctttgtcgcatcctgtgttcaaagatcctaacctcaaaagaacctccacccctaaccgcatgcggcactacgtttggaaacaaaccactccaaagatgcgtcccatataaattgcaatcttgacaccgaaaaaaacgcactggattgtccatgtagtgcagctttaaaggattcgtaaatccttccaaaatatcgtgccttaactcccgagctaagtgtaaaagaaagcacgaacaagttaaagctaccttcttttgacacaagtgctctaggagagctctcactctatgattctgtttactgtaggaagctactagaatagaagccacttcaagaaaagcggaacagtgccgaggaatggacatcacattgtgactgctaaagtgactacctaaaactgctaacttcctacaaacgttttcaactccttcaaaaggtagtatccttatttctaaaaagactaaagactgcgcgaaaaaacgcgctattttgtccaaatcacgagagatgcgttctcttactctgcgcgccaggaaaagacataaaatgatattacaataaatctttaaaatgtttctttctagatgactattccctaaaatttcatcatgtagaattggcaatgttttcgattccattgctttcagtattaactccgcgccgagatctttgtcaatactctctctaacgcgtaaagcttcatcattagttaaatgtaattgctggagaatcaagtcctgtggactaaagtcctgtatatcggacaaatgtaggacgcccctttctctccgcttcaaaaaacgagaaaatagcgccttgcgacattccccgcaactacaaagattagatacaacaaagtgataattcatcacgaatgaaaaaaagattttgtcgtctaagaaattttttaataggagattggaaggcgctacgacttcaccagctatttccttcggatttggaagtaactcaaacaaactcaacaatatatttgaatcacagcgatttctaagcataaaaaattgtaaaaacaatgaatctaagagctccattaaacgattaaagtgagacgaaagagtgtcgcgcttttctccagctacaaaatattccgctattgtaaaatgagccaaagctgtagctttagtcagaactcgataaaacggagaagtgcactcttcaaaccttagactttgaagaaacgcgagaaaaccgtctaaagtcattgttgccttgtccctccttttaaatgaaacggagtttttctccactaaaacagcccatagtagactgtcatcgtaaaattttaagcctcgagtttggaacaaatcttctgaagtgagatgaccgctatccgcaatcatctcctctgtcagctcattcaagttgacgtctaactcgcatgagttaaatgccgtccatgacagataagggtgattcggtataacatacgtaatgcgattccttagcggccctttacaaacatcataatcgattaaatccattacgcaaatccttgtcaaaaatgtttattcatttccatcactagcatcgactccaacacaggctaacgtttctacattggcaaagtaacacaagtcattctgaatcttgtcaagaccccccagcttataccctacagctcttacatctttttctggactggtctggaaatttccattcccaaaatttccaaaatatttgagaccactgaaaaaaagtgccattgctccattaatgttttttgtgttacttaaatattcagcttcgatgttcacgatcgatctctccagcacatctatgaagctcttttccttagcattcactatgaagaaacctggtgctagattatttgcagcaaccaagtccgtgtgcttcgcaggctgcctttggatgtaaagatgatgcaaataaaagctttccatgaagtttgtttcatcatagtttttgtaatacggaatttcaaagctcatctttatcacttctaagcagttgaaaataaagtttgaggatgtgccaggatttctgacaatatctttaacctgcttcaacatattgaaataaacgatattgttcatacaacccttactgcccagtttcatttcacattccatgctagactccaagttctttaattcatctaagtacacatcataatacattttcagttcagtaaacaaaacactgttaagagtttgaattatgaaaagcaaaaacacaatgttactaagaatattcaacagatttcttttgtcctgacccatatccacagtaaccgagataggaaacctggaatgttcaatctgcccctcaataaaacttaaacacaaatctttggctacaaacatagaaagattagaatatttctcagataaatgtggaaaaataggtaaatcgatcttacccaaagctggaaagaaatgtaatttgacagagccaggattctttttcattgtgcctacatttttaaacctgaaaaaattgtatcgacattcttcgcaaccacaaaatagtaaaaagtgctcaagtaagtacaactgaaaacgatcaaaaaaatcgcgtctgaagaatgattctgttttgttttgcatttctgtcttaaaagattcgctccaaaatgcacagctaaagccccctaacttctgcttagattctttactcaattccttcaattttccatctagtttaaaaaataacatagaaaggtactcacataggtagcgacaccagtatccaattccaggcttagcacccaaattaaacaatgatgccccagaatagaaccctacagctgcaagtttagtaatgcactgccatttggggtcaaaatcttccataaattttaaatcgcgcaactgcaaaagaaatttatcagcccttgtgaaagttgatggatacttgaacatttcgtactcatagtctatcaacctattccaaattacaccatctgaacataatcttagcccttttattccaaagcgtccagcagctgatgcttgaaggccgttgattagtctggattctgtcaccggaacaatgtacttcagttccgtgtctccgtttggaatgatgattggatgtagaaactttgtaacactttgaacaagaggattactgatttcagatgagtgcactgcaaacagaatacttggcatgttcttcaataatctgaaaaagaacatccatggaaccatcagtaagagtattgtgtagagaataccgaaaagaagaactttgatctttacatacctatcacaccttggatacatatgccgtggtttcttccgaagaatcggagactctccatttaacattctgttcaaattttccgcctcactttcactcacataaatcaaactgtcatcatgccagttcagggcatatctttctttgtataagagttcttcaaaccctcgcctgataaattctctaatagaccttgcaactttgttgatcttgttatcacaatacacataaatgtgaaaattgggacctagtaggatgacagctctacaatttggctctacctgacatctcgcgcaagttcctatgacaacatactttcttcttagtattttttcgagaataccagaacctgtgatgtaatggatgtcattcgaagaacagaaagacaaatcaaaattttgaaaagcatcgatacgaattttttgaccacattggcgattgacaaaattctttaaggctggaatatttttttgtaagagtacgaactcctcaccgctgcatttggtttctccgtaccacagtctgtctagctcaatatctaattcaatccttgcaaaaggtgggaaatttctcagcccgatactgcaaaaatgtgctggagattccgctatgatgtacaattcatctgtgaccgtatctaatgcaagcatcttatttgatgagcagtacatcacaaatggatcaaagtccgggtccggttctcggtaatttggatgtgcataaccaacagcgcaaagaaattcgtctgctcctaccaaattactccaatcataagtgatgacactacgtctacatttgaaatgataaaattcgccaaaaataagcacatagtttggcggccaagcaagacagcactttataccattgcgaactatctccatgccttctccatatgaagacagcagcaactcaacggcaaaatcaaaagacggtaaatccggagtcggttcaatgcaaacatcattgcacacaggaacaatttctgcaaaattaacttgtgattagtacttccgtcactttcagaaaaattaaaaaccataaaaagtactgttacttacttagataccaggagtactgttgaaccggtgcacttccaagagttgataatcttccaaatctggcagtgacttttccaattttatcataaccaaaatctccacaatatctcgcgaagccgatccttgcaaaagtcagtaaacaatcagcaatccgcgtcaacactttatcaatccaatcataataataaattgctcctgtttctccaatgcatagaattggtctcaaaccatagtcttcggctgaaatatttaaaaaacctaaaacaactactttttcaaacagtgcctcttgttcttcaaatcttttttggtctgaggtgccacagtgtatgtttttcctgtcttgcaggattaacgctgtaaagattggagtttccaaacgaagttttaaaccagtgtttatagaaacgaagtgttcaatctctgctaacgttttacaccttgccaattcatctaattcggagagcattgaaatataatttctcctcaaagcttttagtgccaaagctgttttcctgttaaatcttagactagaattcaaattaagtggttcctgtaataatcctaagtctttaagagtctccaatttttcaaactttggaccatcataataaaagcgagtataaacaggttctgagcaagtgattacatttgtacctagaataccaaatctaacaaatttgtcaaagtcttcagctatgtaatacaaaacatcatcctccaaatcgtgacaaaaaattcgactcgattttcccacaaaaattggcacgtctttccttccaatttgaatcgctccaatcaagcacaaattttccttaaatccttggtaatggtcattcagttctgccaattgttgttctgagtaaccagcaacgtcaactggctgtgcaagccttaaccacaaattctttggccaaatcaaagacaagcattcatttcgatgtcgttcagtaagaaggcgaattccagggaaatcagtaaaacgacataaattcttcaattcccttaacaatccatcatttagttgtccaacacaaggcaaagttttatattgttctgccatcgtctcaaaatttttcattgaagtgaatgtggtaagaagtttgtattctcatccatttctcaaaaactcaaccagataaatataagagaaaaaaatcacatgacaggaaataaattttaaagctttgcagattttttatttcccattacaggaaacattagagtgattaaaaccataagcctggtgttatcggattaaaaacctcttgtcgaaagtaggaatcggatttttaccttttttaaagatcgatttttagaacattcacggtaacaatacaaaacaaacagtgtcattaatattacaaactcagaatctgccactgaaaggaaaatcccttttcgccctaagtaactacacttaaaaatggctatagcagaaagcggagcgttcgaaataaatgtcaatcttggaaaatccatcgcttccatacaaaaaaatcctataatctacatgcgtagacatctctctttttatgtggagttattaaaatttatcattcatcaatatgagcaatgttttttaccaccgaaaggaacgatactttaccacaatggcttaatcgaactaaatactttaattatcgatctgaatcaacaaattacatcgaaacagcagatctatagttggacgagcattactttgccaaaaatattttcgactaaagaattatattttattgtcgcgtcaccagagtcggaaaacataactctcaatccagctgttactaaaggaggatggttatctgggagttttagctttccattgagtttaagttgtgcatacgccctcactggcgtatcttcaacaatctatatgttaccatttattccatataaattcccaatgacttacgtagacttttcgacacttcgaacatacgaggtaacaagtgaatatggatcaatccaaattataaaacagcggaattttttatttttgggaattatacgggatctgtcatggaaaagtcagagggataacaagaattttatcctgaaagcaatgttcgttggaaactggttagggatacaaattccagaagcttttgcattgagactttttaataacacacggttttctattcaggattttgaattctccattaacatacaaaatataaaccttactagggacaataaaattttgggctctctttccacggtttcttgtgatcagatgccaccaaacttgtctccagagaatctcccaaactatctagttattcagttcgaattggtttcaactctcgcaaatcctgatcatctactgttttcttgcaatcccaaattgtttttcacaggagatattctgaacagcgctataaatttacaacatagtcctaatcattatgagcttacagtgtacgcaccacataatttacatttctatcccagctgttttcatatagtaacattaccaattcagttttcatccagaaatgatagacagatgttggtgtcaagctatcctaatgaaggctactttgaagtacaaatgtgcccatgggtacagaattctcctcttcaaattgttattaaatctttttcaaaaaatctagtgctaccgcaaggcacccctattgcaattctcttatatatggaaaaaatgacaacaggaaaaaattctttacgggatcaagaattaaaaattaataaagacattacccgaataggaaacgtaaaccttccaaaagaaaatttcttacattataatagctaatctttattcaactgtgttttagacgacgtcttcttctgagtgtgttaaatgcgatactagtttattaactatatcatcatctttttgaacagaattttcaagatcgattaaatctttatcgccattttcttgagccttgctagcaccgaaaatggtattttgcgtctctttgcctgttaaaagtgaacctgaatcaaaatcctggatttcagcatttggtaaaaaaaatggagaccgcacaggctgcatcttttcagtgaagctaaaattttgaaataaaggatctctctttctggagttcagtaaattcttcaggttgttgtcattgaaagtcgcaatgttagaaacatctgtttttttcgggggttcgagtacgtcttttaagcttcgctcttctaaactaattgtatccgtaaaatccgttaataatttcttaactttttcacctagtcctgattcaaaaagttctttttgaagaagatcgttccttctactaagatccagtaatgaagaactcggagtccacttcacatctttgactaattgattttttttagctgaagaagcactctctttttccttcattgaagcgtttacgtcattagtacctatcatatttaaagtcttggtggaagaatttgctttatttccatttttttgcttaatgcttttttgatcttgtggaggcaatgacatttcattatgctcatcgtcaaaactttgtaagttctcgtggacaatttcttttctgcgtttttctgaaggaagtttgaaaatgtcttcattattttgtttaattgttttgattcgttctcgtagctccaaaattttctgcaagtcattggtcgagtttttagacagttgatcgcgtgattgcactccgttttgtctgtttacttcgttttctggcagaaaaaaggtagagtgataatcaattttatttttgggtagctgaactacgttaacttttggtgagctaacaatgtctattactttgtttgagttgtgtagatctagtttgctcaaggtatctataacttggttaataccgtctggtgccacagcaatttcattgaattggtttactttgtcctctggtctgtgcatagtttgatcagttaaatcaagtatttcagtctgtagtattctgtgcatttttttagaattgtttatagacgtggaatttcttggctcgtccaatatcatggaatccttttttaccgaggataacaacccatcttcagagcctacaaataaatctttggatagcgtgttgttactccgttgttcagtttttataaatggttctggattaaatgatgaaccatgcgaagtttttttagaactactctcaaattgattgcttaaagacgatttcgacaaatctgttaaaactttgaatgtctgaatcggttcaggagtaaattttacacgatcatcccatgtactctttacgggaagagcatgtaactcaagactttttgttataacatcaaagtcttcggttaaaattttaaaaaaagaagttactctatgactagttaatggcaaacttaaaatttgataagaatatatcgaaacaaaatttttgttgttttcaatcgcctttaaaattgcatttttcttttcattaatggtatttaatgcgagtttctccatgttcatccaggatccatgtaatgtaattaataaattcccaagataaagcaatcgattgatgttagtaacatagtagccattttcattccacggatcaactatttggtaaattgtgaaagaaagcatattgttttttgccttttgtaaattctcgccaatttccgctctttcttctgtggtaagattgacgtaatcggctgcgtgtgtcacagtgccccaacgaagaaaactgcccagtttaagcaaatcttttgctacgtttttaaattctgtttcaaagccaactttgttaaaagatgttaaactagaataatcagtaatcatctgtctttgctctaagtaatctttcagaattttttgcacctttagtatttcttgccaaacttcctcatagtctggtttctttttacacaaggtttgatgaaaataaatccaaagaatcaaattgttgtaaagtgtttttacattgttaatggaatttccagttttaacgatacattgactcaaaatccatggattttcgcgaatatcaacaactggtaaagacgatatgttttcaaaaaatcgagataaaaaacactttgcttcatccgaaatccaagcaaagggtaaatgtgacattttcatgactcgttttttctgttgagcattattgaacacttcttaaaaaattagtttaatagtctctattttctctttgattagatacatgcgctgccgacatggacactctaattgatttccaaaaaatcctggtatgataatctaatgttatgatttgctacagctttgctaaaaatgttacctttgcatttttaatcatcttgcaaaactttttttcacagcatgatgaagagtacaagtacaattatacgtgtattacgccaacagtacggaaagcccaaagacttgaaagcgtaattaacggaattatgctaacgctgatacttcctgttagtactgttgtcatatgcactctgctaatctactacaaatggacaaaacagacaattacttctccatatcttatcacactctttattagtgattctttacattcattgactgtgttacttctcacattgaaccgagaagctctcacaaaccttaatcaggctttgtgtcaatgtgtgctttttgtatacagtgcgtcctgcacatacagtctgtgcatgctagcagtaatatccacaatacgctatcgaaccctgcaaagaaggacattaaacgacaaaaacaataatcatattaaaaggaacgttggaattttatttctgtcttctgccatgtgtgccattccagcagtattatatgttcaagtggaaaagaaaaaaggcaattatggaaaatgtaatatacacatctcaacgcaaaaagcatatgacttgtttataggaattaaaattgtctattgttttctctggggaatttttccaactgtcattttcagctatttttatgtgatttttggtaagaccttgcgtgccttgacccaaagtaaacataacaaaactctgtcattcattagcttactgatactatcctttttatgtattcaaataccaaatctcctagtaatgtctgtggaaattttttttttgtatatagcaaatacttcctgcttaggcaccatacaaagagaaattgtgcaaataatatctagattaatgccagaaatacactgcttgtctaatccgctagtatatgcattcactagaacagatttccgattacgattttacgatttcattaaatgtaatttgtgtaattcatctttaaagagaaagagaaatcctctgacaataaaaaattgaacagtgaagcttgcttaaaactttgaaaattttttgtgattttaaataaaatttaaaatcaatttatcctaagcttttcaggctatgactttgaatcaacagccatctaattgcagactaattacagctaacgatccagtacttgcatcgaattttacaatgcagcctacttttaaaatagccgataagaaagttgtactcagagatcataattacattgcagtcaaagattttgttctatcaaggtctttcatgcattgcattcgatgtcaggaaaaaattgaaaagaagacatccgatagcattagagcatattccattaagccagatttcatgttttatgactcagacgacgaagttcgttcgtcaccatttttataacaatatttaaagtagctgaattgtacgttctgaaacagtctgaacggatccgctgaacgcagacacaatggaacagcaaaaaggattttcgattccattttttgtcactgacgaaaactgcaactttgtgcctgaaatattacctcgtatacatactaaatttcttaaagatgtcttaattgccgattcctacaactctgttagttgggcaaacagttttattcccatgcctattcaaacgcttgaacaaattatggttcttataacaaagttcaagttttctcgctcgcgtgattttttattcccagtaattcgattagctgttcatatcaataggttccacacagggaagaaacagctgaaaaccatgatagaaattatgaaaagcttgtttaacaccgaagaggctatgcgacgattcgatgaagcattgatgattctattttctaatgagcaaaccaatacttacatgacaaacatagctttatcgatgcatgagaatggtcttccagattcaaaatttatgaatgctctaaaaatgatttacagagctggaaattcttttgataatcaaccagacaatgatatagaaagctacaacgagaaattaaaaatctacaactacctaattaaaatacctaagtacacactaaaagctggagttgatttatataatgaaaatataaaagatctttcgattggaatccaaagacaacctactttattattcacatctcgtaatgatttttcattgaaagctatttataatgacgtgttatttctagtttctgcatggaatatgatcatcaactataaaaaagaacaaagaagactctttagttggataacatttgaaataaactctttaatggagaatgttgtgcttgcagcctttcagttaccagatttaaaagaaatgacacttgatttaagcgctttgattgccaacatgaatcttttaaaaccaaatgatgattacagcccccattttaaactaattatcaacaaattttttgaaatcggaatttttgtcacgaaatcatatatttgtattttgccttcttttgtcaaaagccaacttatttcgtttgaaaacgttttaagttcaaacagacatgcggaagatgtgactttcatactaacatcttccaaggaatctgatgatgaatatgatgaagataaacctccacgacaagtagatccagacagagtggacaacattttaatggaatcagatttttttaatgtgaaaccggaaaacgccttttcagaaatcgcattaatgccaatttcacatgacaaaattatagatgtcaacaactcaaacatacaagttcttgaaactgaattggcacatacaaatttatttgtgtatagcgcaatagctcaaaaatatgatttgcctttaaaagaatacgtagagcgcttaaacgtctacaatcctgatctatcatctggaaactctacacccgcgcggaattctaattctattcatacaactccagttctaaatatatccagaccaggaagcactacaccctctgggaactctgcaagatatgggaataacacacctagaagtataactccggttttagagatttcaagatctagaagtgctaccccttctggaaattctgaaatctatgagaatagaacatccccaacgttccgtgtttctaggagtgcaactccaatagaaagaagttcgagatctgctagtataatttctggagaatctgttcctggtttttttaatgaccaagaacgtttgagcaccaattcgcctatttccataaatggtaatactccaagacagcaaagccatggggacaatgaaatacaaactatagattccacggatgaagactcaatgaatgccccacaatcaccccaatccatctattcaatttctagctatgtttcaacagacgatcaacttctacattcaccgacaaatagcccatttaatctttttgactctgtctcggaaatgcaagaagacaccgaataattaattgttttttatttagctaattcattgtatgacaacacaagggcaattgtttgattaatttccacgttttttagcttttgaataatctcaattaaaacatctctggtcagttggagtcgttctatgtatgaaaaaaacattatcgcgttttcatgctcatcgtctccaagcctcagatgactttcttctagaaactaaagaaaaaaaaagttaaaagatcttttacagaagaacatttattatttttaaaaatgatttttcttaccgcataaatcatgtttaagaaaagttgcttttcatgctttgttgtcatcatatacaataatgctgtgattttcctgaaaataaaagagcggggttagacaataaaattttgaaactcgtttgtgtagaaataatagaggtggactcaccgttttacaggtatgtgtgtgaattgagcgacgatataacaatcctcagttttgtgaacatctagattgaaaatctgcttgatttcttgccatctcttaataataaacaaagcttcaatcactacagactttgtcacagttgtggttaatgttaatccagaaaaaataaatctatatgttgtattaaaatccatttgaaaaagatattttatatagattgtctccactttagatataatattagataacgtcatcaatatctgtagtggacacagctcgcgaaattcctgtagtcgttgtcttctccaggtttccatttctcacaaagaagagtctaccctcgtagaagaacactaactaaatgaatttttttaggcgaacgcttaaaaaactcttttactggcacaccgcctataaaaacccccaaaggaaatttttatgtaaccacacagaaccaaaaaaagattaaccgttattagaaagtgttcgtttttaacgatttttattggcacattttgaccgggttaaatttcgtcttcatcagatgtatccacttctctgaaatcctcacttaaatatatagctaatccggcagcgtgtgggcaggtcggataaatttcatgagtaattgttaaattccttggaaaaaatttgtatgtgcgatatgttctaactatcccctgtcttaataaacattcaaaattttctgcaattttgacacagggaccgatcccggttccaattgcgtcaataccataaataaaaccttttaaatccatcattaaaaataaacttttaggaaacattaagtttttaccgacgctgccaatgatatgtccatagtatggcatattgtcataaacgtcagctagaaaattccattctgtgcgattagggaattcttcttttctggttagaaacaaaactagtttttcatccatcttttccctcttcaaacgaagagtgtacactttcccactgttagccgctattatttcagcaaacttcacaagattatactgtgcatgaatgagactttgcaaaacgtgatcgatagacgttaggaagggaatgtcactatcttgataaatcggatcaaaacggtgcaacccgaaataagcaaagcgctctgttgattcagcaagcaaatataaattttctttttcgaagtccaaagcatagaaacgctcttcttctccgagaagaatgatggttttagcagctgctgttgttacgtcgtttttagcactcagaaaaccgatgacttgtaacctttcattgcaacataggagatagcaacctatgaaaacaacaaaaacttattagaacatcatgacacattggaaatgttttgactgcttttgcaacttacataggtcttgcagctcggtttcactagtagttctgaaaggcatatcccgcaaaggcgaaatgattattttcctactctgaggccatcttatgaagatttcacacccactattttgagtaacgaagtcactaagagaatcgcgataaaaggcttgtttaacaaggcttaaatttgcgagtgcatgcctaaatcgaactttttgttcactttcggccatgttgaagcacactctaagcttatgaaaacagcagttgtgactaggtttttatatattactgaagcatgacgtcgctttatgcttaagctggaaagttctgaaaatatacagctatcttaaacaagtctgtttacaatagggatttccttttcctgtaaatgctgcctgatactagaaatcatgtccgtgaattccagtatggaaatctgggaaattccaaaatatatgatatataaattcctacttttccatgcagcatcattaacgccgaatcgaatatacacattttcagagctgcagttgacatactaaaatatggctattaagatcaccgtatgtcttcgatactttaatcgagatcgtaacgaacttggaaacattacttttaatatggaatacaaagacaggagagtcgctgtgacatcgagttatattcgggtacattttgtttttaatcagcgttaactgatcaaacttagaaatgtttcctttaatacaaaatgcggaagaaaaagcttacacttacctcttctttatattgagtaaaaatggaccgcggggggaacagattttaacagttctagattacactcggtttaaattttttgatggctcagtgaccattgcacactcaaaaaaaaattattttctttcaggttctctcagatataagaaagatgattatgacgttattcaaaaacaaaaaggtaagcgaattacatgtaaacattcaaaatttattgtttgttaaacatgtagaaactcacaatgttttctctatgatccagcaaagacttgcaaagacagaaattgaaatgagcctgacagtcacgtaaaagtgttcaaaaaagattcctgatgataatcgagaataaatcaaccaacattcttgtcaactttgcgccgatttactatcgacaaacagaaaaacaaaaaaagtaccattgctgatccgccgacaagaaacactacaccaatagttgtcgcttgggtttgatcgaggaagctttcgtaatcattcaagaagatgacatttttacctccatatgaagcgctgagatcttccaattctttgtacttgtaccaatcaagccacgatgacttccaagttttgcgcaaaaatcttttataaatagtttcattgcgtactattgtaaagtttggatttaagactttcctttgatatatttcatcagataaatgaggacatatcattgctacgaaataacaatcataattaaatttttgatttagaatttcaagtgttttgtttttatcttttccgacgcttctccacttaactgcaactatgccagatcttagctgcaaaagaaacttttgaccccctgtcataatagtgatggaaccacccgaattatgaccttctaaccaacattcaagtgtactgttagcccgagaagcaaagtgccattttttggcaattagtgctcttaacataactcctctaaagtaataattgatcagcactctcaaataggttaatttatgagatgttgtagtaagatttactagactcatttcgcgaaatccttcagtttttaaagacaaagaaatcagaaaagctgttcttacagataaacaactagaattccctattagcatttcattaacataacacgtggtgacacaaacagcttctaatttattatctagaaatattatattctggtgacatttcaaatttgacatgagtgtgagagataagcaaatcaaaaagacaaaaaacatcatctcttttcccatggtcctttataaagacttcacaatttcttcaagaaagtccacggtacttctataaaacaaaaaaaaacacaattaactattgatgaacattgcagcatttttccaatgcattgccatacataccccgaagaaatttttcctttgaaaagatactctagatgtgaaaattgtgttgaagaaagaagttccgtcttagtggacatacattcaaacgcaggctcagggagtttttgaatggttgatattctgctatcttgttctttccccctttaaatggccataaaaaagaaattatcagttaaagacagcgaaaaatttaaaataagtaaaaaacaataaggcacctactcggtaaattgttcgaaattcaccgggaaacccgaagttgaagtgtgttccaagtttttcagtggcgagtttgctatttcttcataggtttccaatgagaagtttgaactctcttctagcatatctaaaggtgctgtctctgtctcgttagctgtgtttacctctttatagggatacatttccgctgtggtttgcggtttgtaacaccgttctttaaaaaaaatgtcattttgtgatgtttgagtactgcgagtaaaatgtccgagtcccgtttgcgtagatctggacactaaaattgtcacaccaggtgtatgacacattttgtaaatcttgcaattatttggaagattgtcattttctgagtatcctatggacatatacattttttctgcctgtgtctctctatcattcgaaagcttgtgaccaggaagaactctttgaaatcgcgcaggtagttttccactaatattgattgttttttgtcgtattcgatgatagtaattgataaatctttcatggcattcatctctcgacatcttctttgacatgccatgtgtaattgcattttgacagctaaattccaatttcgtggtccagaaatcttcaaatgtgggcgataaatagaacatcacaccatcttcataagcaaacacatgctgagacaaggacagtaaaaaaactatttgtcttcgcggcgtcccagaagctgacacccattcttcggcaaccccaaacatcaccatctttccctcaaatggataaaatccgatgttaactaaacgtttaagtctcctttctggaagaatgtcagtcatatcacaaattcgaatattgatacacattatgtgttgaatggacacgccatccttcattatttcttgaactgttttttcaaaaaactttaaatctttcgaagctgcaattaatttttctttgcagcgcagcatcgtcgttaagccacattccttagacataatcgtctcttcataaaaaatactgaattttaagcgtatatattcaaccccccggatatgggcgtggaaattaataaaaacacttcaaaaagcaaactttttattgaaactcattaatgacacatgaaatctaaggtcccgtgaatttgaagatctggagaatccttagacaggcagtctgaatctgaaatttccattttttcagttgcacacaaattttccacagatatataatcacagggatcaatttccatgattactttaacactatcagatctatcaaggtccttacgcttattaagaacagccataacatgcagccaaatttcaaaaaacatttttttaacagtgattatagaaaaaataaaggcaagtataggaatgattaaaagtatccaaaaaacttcaaagtaattcccgtgtttgtaagttttgtgaaacaaattttgaaaatattcatctgaattattaaattcaaggacgttaaaagagtaattacatttttgatgaattaccacacattgataattagcggactccgtgttaatagatttaaaaaaaaagtagaattttttcccttttaagatgtccgatgccaaatattcttctgtcaaatcatcaggaaccagtttattttctagcttccattgaatactcaatcccagtggactataaagctgcgccgaacacgttatgttagatccacgttttgtgatggacaccacaggtggccgatatccatcttgaccgaaggtcacatgtgcagaaaaatctgcgagttgtttaacacaaaactgctgcacataaaatttgagaataagtaataattcaacattagcatacatgttttcgtcaaaaccactgctagaaaaatccaacaggttgacattcagtgtcgtgtcattatgaacttttaacaaataatgacttttcaaaacggtgtcaatttcacaaatgaattcagcgttaaaattgtggtgataatgaacactgcgattcctatgtgaccagacaaaataagagaaaatgctgtttaatgtagattcgtccttgttggtagaaaagacgtaagacaaagcattaaatttcgttggaaaatctgtgaggaaagacgaaatactagtattgccgacagacagattcttataatgtgccagttcatagttatccatcatcaattcatatttctcaagatgttctttattgattattgacattgtcaacttatgtgccacatatttggtaaaatgtacaatgaaaactaaaagacatgtttttttcacaaacattgctgtttgagagattcttttttaggtaacggttcttgtccaaacatcaagtttgttagattgattattttctctgatactggttctttttgtatgtgctgtaaaggccacgtcagaactttctgaacaccgtctaaacaggaaactcctaataaaactaccgctgtaacaaatgcaaggaataatatagcaatcaatgtgtagcaaagcatgtctacgaaaacattactagacgttttttcactatctaatagatccaaatccacatcaggtaatgttacctgtatttgtgttcctgtgttcttattcgtacaggtacaaacatatgtggtcatttctactcttagaaaaattagaccccaaagcacatcactaccatacaaaggagtaaaagcacccgtagagttgaaaccaactcttttccactcttctccaaacggactttttatcttttgcagaacttctaaggagccgaaaccgctaacaccccatcctgtatatttacaaactgctacctttacaccattctgtctaaatttcgaaaatgaacaatctatgttattagttctatatcgttgttcatttctttgttcaatcataggattaaagccttgcttaaatgtagcttcgaatgttttcgcgagtgataggtactttctttgccaaaaaaaaagttgattgaagtcattttcacaagaattgatcagaaagtttttagcgtgtgtcaaagtgtgccaaattcgataagtgaagggatcatcttcacctaaatagtttttaatcgctacccacgtgctgtttcttttattttgcaagtagaatgtggtttcaagaattctaggagaaattccagtttcattcatacgtctcagacggataaaacttttaaagggtgaacagataatttgaatatgaatgtaagactcgacatcaagacagagtttatcatatcgcttcatcagtccttttgtttttttaaagttcttaaacaaaaaatgatttagtgtagaaaatacttgataacagttgaaagccaaatatttgccaaaatcggtttcaatttgcgtttcgctgttgccaaaaaagaaagcattgtctgtcattgccgcgactgcagagtgtctgattttatcgtctgaacattgtttgctcaaagatatgtcgaacaatagcaaatcatccactgtagcattcacatcaaaatccacaactgctaagggacagaaatccggatagagttctccataaatcacaggaacgcaaaacagcaagatagtccacatgttgaattagaaaagagtgatgagaaagaaagcttttatttcttaatatatatttgacgactgaacgtcacagttacgcccattttacggtgataaacgttaggggttccgcaaaaatgtgtgcattgatctttctgtgatgacacagtggttagcaaagcacatctaacataataagtctgtttttctcagtcataggattccacaacaggataagacatttgtgctggtctgattcctaattacatgagctgtatttacgccagaattttgtttatttcctttaattaccctcaaaaaatgaaaacattgatgaaacatacttcccagtgaaacgctttcaacggagatcatgcgttgatggtagataaaacacaacaaggagaactttgcccaaaaaaacatttattaatcccagacaccaataaaggcttggttattgtatgcatttttcggtttcttagaatggttgcgtttggggtttttaattagtaaaactaacaacgctaacgctacaataccaataaaactaactgctgcaattaaaatcacaaggaacaaaacgaacttttttaaagggctattcaaaagttgaggttttgtcagttctggagttgaaattgtcagtgtgaaaaattcagatgcattcccactgttttcatgattagtagtactgccactggagaatgtcgaggtctttgtaaaatttaaggatgtagattcgacattctctttagttgttgcgatagtcgtaggtatactcatagacacagacattaaatcgctcgtactctctgtatctgatgtgattgacgtggaactaaaatctgaagttcttgacatttccagagtgggcgtactagaaacagtactcatgttaacaaaggtaaccatttctaaaaaaaataaaattccaaataacattttaaacactgcgcaattagaagaagcctagtttaatattgtacgtgtgccgactaaattactgtttttaagcaacgcaaaaaagtgctggaatcggtgtaaaattcagggcttcgtacccccatatcgaacattgaagatgtgtagaataagaatcagacataagataaccgatattatgagacatgccagtattataaaagtccctcttcggcgcacatttttgatttcagaactagaagttgaatttattgttcttggtgatagattttcctgatgcaaaaaaacggaatgatcgtggaacatttgcaacattacatcattataagaaggtggcggtgtctcatgagtcatcttctagggatatttagagcacctgataaatgataacatattctctgctattgaaggacttatataatcatgatatgcaatgcaagccaaaataaacagaacaaacaaataataaatccctttccaacaatcttcataggtctctgggaaaaaatggttgtacttataaaacattatgtgcagaattattttttctaccaacacttttccatagtaatggttgtttaaatatgttcctttttttccttttacaagtatttccccatggacagttgatctgccgtgaaagctcttcttccacatttctaacatcgtttgttctttcaaaccaatacccatgtagtcgacgattttcattaaatcgtaaacaaccgattttcaaaaattcagttatgttatgtgcgagaaaaatgatttgttcatcatctacaccaaaaattttcccattcacatcgaatattatcacaagttcaaaccacttcccaaaaacgttgtgttttacacaaaaaagaacatctacaatgttgcaacgaatgacccttttccaacggtgaaggtcttgatcagtataaggtgtcatgggaagtctgcaaaatcgtgtgtatgttttataaggactacttttcaatataaaacaaacgtttatattttcatccctataaatgatcatatcagagaaagatttgctatgctccacgattttgctaccagtttcaaagtccacgataaaatcacacaattcgtagatggggtagaaaaacttcaatcctactaaaaagaaatcttgtaagtttgatgaaacatagtaaagacttttgtcaaaaaaaccattgtagacatacaaatgccctctgtcaccttgtaaaagaattggtcctctgcaagttgattttttaacatgatgtaacacaccaacaacgatcaacgttttttcacaacacaagtaagtgtttcgaatttcttcgatgtcttcctttgaaatttctgggattgtttctaatgagtgaaatgtaactcgccattcttctgggaaaggcaatacgaaagatgtaccttccttacttaagatgaattcttcgagaagagtaagtttattgacacagcacaaattcgctaagaaatccatgcttcagttttaaaattacccaagaaaaaacaaaggcataaatatttcaattttttttatttagcacatttagaagctgcaaattttctttagaaaaaaattacaaagcaagctgaacaataaaaaaggttcaacaaatcgcctgtaaaaatatcttttctacccactgtttttgaaatttgagcaaatagagcgctataacctaagccaagaaagaactcaaacaacaatgaaaagaaacaatgttctgttattacccctgctaacaaacacagaatactacacagaacaagttgatatagtttagtgataaacaaattactatgtaagactgccaagaaaaataaatgctggcaactttttcttggtaaatacaattttccaaaccaaaccagcagcgttaaggttaaaaattgcagcaaataaacaataacatcttttatagccatttggtacgggccattcggtttatagatcggtttgtatcgctgaagacacatggcaaactgatgagagttaaccagaaacttataactggttacatatggcgttatcagaaacactgtaacaagcaatctgtaatgaaccaaatctgatatttttaacacaatggcaattagggtgccgaaataagatgccattgaatgcgttggaaatattagcatgcatctacagactatggctctcaagcggatttcagaaaaaaataaaaacgagcagattaccaaaaaaaattcatcggtgatttgcaacacgagtaatgataaagttataattttgagatcgttgaaaggacaatagttaaacaaattcacccgacggtaagtcaatagcaaacctccgctaaaaaggaatattagcactacttgttcaaacagcgttttctttatcataagatggaaacagctttctcccggaattacattccctaaaacaaggcccatagaaaaacttatgattacattccacatctttgtcttttcgaatttggggtatagtcaaaatgtgcagaatcgtcactttcgctgtcctctttctcattaaaaaaatttgttcctgtgccaccatttttagtgggcaccatgtaacttgtaattttgtgttgcgtttcctgtttacaaaaaaaattatttccttcctccaccttgtgatttttctctcctttttcctctgtttttgcttgacgttcaaattttgggtcgtctttaacctgctcttgacttaaataagcttctacggtcagaaaaacatttttagcgattaaaaataatttgtattctttgccagctattgctctaagactacacgaagactttaaaactgcacaagtactaaatgcttgctgtagatttttggaagatagtacaagtctcatgcattttgcgtcgtgaaacacaactttcccgctatgagcaaattctatttcgtttaagtcggttagaaattttatacttggcgggttaacttgcacaactatttgtgccaacgtcatttcatttttattactgcgtttgttctttgtgaccggagcaagccattttaaaatctccgttacagttgaatggtccaagtctattcgaagtgcagattttccgctttctcttacaatttcttgaccattgacacaaggaatagatgcttgtgcacaaatatctgatgccgtgactaaaaaccgcgtatagagatcgctatcatgttgaatatacagtttagtgacatcaggatttgatataatgcccataaaactatcaaataatggaacaaagttatttatcgttttagtcgaaaaatgatctgtatcggttatatataaacattctgcatgaataatcagctttaaaaccaaatggttttttgcagattgaattatgattgccggttgaggagtaaaagtaactgtagtattttctcgcaaaagctttgcaaaagctcttagaggcttattgattgttttccaagttttcatgtgaaaagccatggtgggaggctctttggaatctcgatgttcgcgatgatctcggtgactatggtgttctctgttgctacgatccatgctgcaccaaaaatagatattaacaggaagagttgtatgagaatactaaaaaatcacagagatattcaaaccattatatactgtgtttttttggcgccaaatttttattacatcactgaaatacatgcatagtactcatcaccacaccatcagaaaaaccactcagcaaatcaaatttttttgatggattgacaccgtcacacttttgatttttatacacagcttgataaattcctgttttaaacccattttgatacaaacatactaaaatgtccctcatattttctgtcttatttatgaaaaatacatttgcttgtccatgatctgtaaacggcaacgcaccgacgtacatatttagcatttcattcacagaatagtcaaaagcattgagaaaaattgtcatttcctgcatttcttcttcggaaaataaatttttgttgactttggacacatcataatttacagagcttaagtactctaaatggtttttaaatctgtttaagaacaggccattgtacactggtatgtataatgtctgtaattcagtagaatagacagacagatcactatggaaaacaggattaggatgcaaaacttttatactagatcgctttaaaatcttatttccctctatgggacaaaaagattgtgagcaatttaacaaatcgaactcttttgacatggccgaaccagacacaaaggttagatttctaagcccatatttttttatgtcgcttcttaaattcgtccataaaacatttggtaatgtatattcaacattatcatacaaatcgcagtgcaaaatcccttgtgcatatttggatctttgaaaaaaactgcaaggttccgctccttttttgcaacaattcatacttgttctaacactagaatagtaaatgttctcgcatactattcgatataattggcatccaagttgagaattaaatggcagattcattgacattaatgctgaatgtaatccagtaacacagatagccaagcttcttgcattgactattccatccattaaaaaatccctattttccaaagcataatctataacagcattcccaatcaaaactaactcagtcactgtttttctcattttctttaaattgaaaattttatctctataatgaaacatatctatgttagtatgggacttttgttcttctgaaacgttttcgacaaaataagaaagatttaaggcaattctgaaagctgtattcaggccatattcaaaaggaattacatccatagaatttccaagacagtaggaagctatttgaggtaacatggagtacttatgtatatttttcctaaagatgaatcccatctgtcctctgcgtaggcagcgacaaatattatccagcaacgtttcagttttgattctggcatgttcagcggtgcgttcacattcaagatatttacttgtaaaatcagattcatcatataaccctaaattaattgccagagctttgtggaaaactgaccaataagaattttcagttttcagccgttccataaaaatttctggcagtattagacaaaacttgacttgaacagttgttggcaaaatttcacagaagtccagccacattaataatgacaggtgccaaatttcaagataaattgttagaccagttgttttatttgtgtccttctctacaatttgtaactgagacaatagcaattccataagagactctgcctcgtagtgataacgagtcagatttacactaacatatgatccatttaacatcgcaggcaagaaaaaaccactgttaatgtccaaaaaatcttccagagaaaagttactcacattatgaaagacagtgtcaaaaacactctttttttcagacactaaacccaaattactcatacaaggaaaaggtaacatacaaactctcttatacaataaaatcaaaatttcttccactagagggcatttgtgactaacaaaacttttttgtaaatattcgattttttttatttgactggccaatgtcacactgattcttagaaaaatcgttgggatgttttcttcgattccgttaaatgaatttgaaatctcatcgagaaatctcgatgcagctaatactcctggtgaaaacttcgctctccagacatggatagctgcttgcaagattttttcaagttctactttggagtcacgtacaaattcaatcaattctttttgtaaaatattttcactttctaaaataagtgagatggaatcaaattccgaagcagagtttgttttgagatagaactggcctaacaaacgatcaacgtgcggtgcatcatgcattgctcccagtgctgaaattatggcatcacgtaagcaccacatatctaagcccgaatttaagcgccggagaatttttgaaatttcatataactgcttataaagaagagttttgtgatggaagcgtgaatagcaaaaccgttttttgttatattcatcatgacaaagacatttcctcaagagacccatgtttttatttatggaaactttattgttaggatccataatcacaagaaaatttttctttcacacaattcgacaaagacgtctttgagtcttataatggttaatgagataccctgtaagtctaaaattcctgattttatgttttgggttttacaatgaccaattcgttgaaggcttccaaaatagtttagatttccatcaccgttgatcaaatagttcataaacataaatcgttctttggaaaacttgtttcttaataaatctatcaatacttcttcatgtgtcagctcagataaaacaatgtagatcccgtattctattttattaaatgcttgcctatagatataacagaggtaaatgtactgaattgcattttgtcttggttcccagtcaggttccaataataaatctttcaatatgaccaatccatatatattttcctttcttacgtcatatacatgaccttgcattacacaggatattagacaattagtcccttgagagatataattagttactccaaacaaagacaccttttcttctaagtaagaacaactatctaacattgtgttgatactgtcaactaatgaagttttatacagattagctaaagaagtcctcgtgcagaaagacacattgaaggcattcatggctaaaaacaatacactaatcaacaaaaattttggactctccgcgtctgtttcaagtctgaacataagcattcctaaatggtctcgttcaggtcctaaaagttcgcaaggagtaaaacttcgcgaaagcacacactctttgggaacaccaaaagctagcaaacttttgatcttttttttctcattttcaatgagattatttaaggaagtttcatcaattgtctgatgtttccttttttgaagcatttccattgttcgcaagcgaaatggattgtacaaatttacaatttgagtcaatattgaatttacttaaaacagatgtgtccgataatacattcttaactataacagcgaaaattgaaattttttctcttgcggctgaaagtatcacagcagataagatattgtcatttgcgaaattattaccaatacacaattatcatttcaactttattaaaaatcatatggtgttttatatattaaattatagtactctaggatttgccaaaagattttcaatagctgaaacactatgtagagaattaaaaattttccacagaacattccaatcaacgtctaaattacaaaacttaaataatgcagaagtcctttatcaatttgaaaaacttattgaatccattcaagtattcaaggcggaattggcatcgcctattggtaaacttctacgtcaagaaacaatgatctatgacaaacccacagaaaaatcagttaaatatgtcattattcagcaaaatttgataaaaattaataacttaattcaagactgtgaatcgataaaaaactgtagactcatagcggagctgatagatgaattatatcaaaaagtttataggtggtttatgcaaattttcacatacgacgatattattttccccaatgacaatttcttagatagacttttaaaaatggatttctgctatacatattacacggcatctaatcagcatttattatcactttttgaacagacaattgacaatcaaatttttatcgacccttctccatacttcgaaataaatccagtatattctcccgaattacaatttatgagcacatttagcttaaagatattttcaaaaaatatttcagcgaaaaacgaagatctatatatttatccacttttaaaaacaaacttttccatacttacctttctgagtttagaaaatatttttttccatcatggatttatataccacatcttgcatagaacaaatatcacaccaactgaagaaaaaaaattaggaaaaataaatggattcttaaacacggttattcagcaagtcctaattaaaaagaataacttacaaatcactttcccggagttgcttgataaaatctatcatttgcatagaataggcttgaatatcgaaacggcacaaatttttttacaaatgttaacaacatacaaaccagcgacgacaaataataagttgcagacatttttcacgaatttttcaataataattttttcggcatatattttttttctatgtattgagttattcagcccaacttttattttccataataaaaaaaaacttatcctcgagaaacaaaaatccatcatactaattctcggtgaacagttctctttcatttggaaagaggtaaatgaaattgtagatttgttatttagtagcacagttacagaaacctatttcaaattttattctaaaggtgccgatgactacgaaaaagattttctttataaagacttaatggaaaaatggggagaattgtttttcccattaacttattcaatgacaacgccacagaaatataccgacaagcatgtatcaagtacagttttgaaaaatttatgtgatacagcatatcaaagtaagatggaaacagcgtatgaaagtctattaccatatattactcacccagagttcaaattcatttttattacacattacgtcagaccttctttgtcattaatcacaaacttaacctttgaagaaataaaagataatcgaagattactaatactaatattcgcgtgtaaactgctaatgccatcaaattatcttttatcacattacttattattgttacacgctttcacactacaaattttcaaagtagatcttggccatttttcaattatacatgcaattactcaaaaaatttttgacaatattaattctctgacccaaactatttttattccaaaaacaaattttttagtcagccttttattaacagcatacactgtgcatatgcaaacttatgtgaatccttggatacaaaaaacaatcagtgaaaatatagcccttcttaaagaatacatcgatttcacaaagaaatgttcaagtactttggcaactacgtgctatttgaacttagaaaattttgcagtaaatatgtattttgggaaaaacaaggttggaagtacttcactatcagctttttatagaacttgctctaagctaattgaggaatctaaactgtttaaagataggcttcaagaaatcaaagtttcaaaaacattgtttatagagatgctacaaaatgttgtgaaaaacatcacaaaatttaaggatttagtctcaaatcaaactttgcaaaattttataattattgttgaaagaatctcctctcatgcaaatacaacatatcaagatgttctcaatagcatagatgaatgccatttttcaaacatgcaacttatccaatcttttaaaaacatcgtgtatgtcattgatgttctgaatactaaaaacatctttaacttttctctcgcatcacaattaattgaagcgaaaaaacttgtaaaaaaacaggacacctataatcaattaaatgtgcaagatgattttgtcactgtattaaagtcacatctaaataatctgtttgaaaagcagaagcctacaattaatattgaaagaagatttatgttagaaggaatacccgacataaaacagattccattcttggatgtttttgatgaaagatatagactaataccacaaattgaaaagtatctgcattggtacattgcatatagtgaagctgcgcaggctgatttggtcgagcctttactcttaaaacttggttagatgagaatcatagcaggaagcacaaatcaaaacgatcctaaatacggaccaagagccggaaagcaatgtatgtcaaattgtttttctttcttgcatacagtttatttgaacggaataaacaatgtgttaaataaagagtctattgacataatcatggaaaatggagcattattggataatatcagtacaacgacattgaaactcgaaactggcaatatcccagaatatcgatttttcacagaaatcccaaaaaaaattagttctaattttggcgaaacaatacatgaattatctagaccctttaatggtaccttagaatcacaacatatagataatgaagtttatcttggactgttagactttctattgtatgggaaaaataagaaaccagcttttattgtcatcactataggggtaatggcacgagctatatttatagttgatgaattgttttacctttttgattcacatgcatcagacacagaaaactctgcagccatctatatctgtgaggatattgacgaattatatgctctattggccatagagaatgttgcggaattttactatgatgcagttttttcatatttcattgaaacgactgatttatctcttgaagacggagatgcaacaattttaattttaaagacttacaaagatccagatatagctcttagtttgaatgattttttaacaatgtattcatctacatcctcaacaaagacagcggaaacaaacactttaatttcaaaacaatcaccaagcaaacgcaaacaagaaaaaaccagtctaaattcaaattctctagaaaaaaaaaggaagcagggctcatcactcaaatactataacaatgaagtagatttagtaccaagtttttatgagcttagacctcaatttaacaatattttatttgagctttctaatttcccaattgtaaaggaaaatgtaaattggaccctttacatacagaaatttgcaacaaagtctacacagccatttacaaaaccttttatatggaatagggtattccatctattttctcaagtggttgacgccttaattatgattaaaaacgatcattgggatgagacacaacagcaaaaacaattcttcacacatttcttgccgttcaaagaattttctgaggaatttgaaaacgctatagaggcttgccgagaaaataatcttgatctaatattgctttataaaaactatctttcgaaaactactgcattcaaaaaccttgaaagaattttattaacgaagtttagcgccattgtcagtccggtgcatgaaaaacactacacgcttgtaaacacatggctaactaacttaatacaaaaactagtcaaacatcccgaggataccaatgctttcatcaatgactacgtgttaaaaaaccccttaaatcatttcatttgtttgaataagaaggaaaagcagagcatcgctctactactgaataaaaaaagaatgagtatgctaaaagatgtggaaatcgaaaagaatggttttgttcaactccaagcattcatcgagaacataggagaagctccagcaaattatttagatccggaaaatgcacgcaaagtgaatgttgaagaagtctcagaaaaagacatcccaacattatccacagataaagtttccatacccaatgaaagtatgttcacatcaaataaaaaacacagcatagaaaaattaatacatgctaagctgaaagccattttgagtacaatggggcaaagattaactagaattattcaagaaaattataataacatcgctgcaggttttctgccggtgaacgatcttaataatctgtttgcctatttggtcaaactctattttgatgtctatagcatcaccattaacggatttgtggtggaaaacgaattgataaaaaatattgaacaaatttacgacaatacgcaatatctgagatttggattgacacgcttcaatatgcaaaatttgacaccgtttactatatctgtccgcaaaatgttcctggatttttttctatcacaaaaaactctgatagatagagctgaagaaattatagagaaccttgagtttaaatcagttacaccagaaggaaaacaaaaacttgccacaaagaatatgctcagagaacaattagaacagttgaatgctatggatgtggatgatacaataaatctgaaaacagacacattaacacatcaagtattattttcagaccaagaattacgcatgatacaagacttcattttacaactctccattcacaatattccaagcattaactttgtgaaatctttgaaattacatattattttagaaaaaagacctgatatactattagctctacaagaaaaagtccagaatattctatatttttattttcaagatctagttaacgagatacctgctcaagaaaatgttttgtcaacaatgttatttataatagagctttttccagccgacagtagaatacatctactagaaaccggatatatttccagacatattgtaaaaaaatggctaaacatgaaatcattgcaagatgctgaggatttaattcgatttataaatattaataaagaacaactaggaaaatttgaacatcagccatttggaaaagaaattcaaaaactaattgaaaaaatacacttgttctataagcaaaaagtaatcgagtatcaggaagatgtctggagtgaaatggctaaaaatataattttaacttcaccctctgaattatctcaatttttagcttcagctcccactcaacgtatcatacaaaaacacaaaaataatttagatcagaaacttttaatacatatggaaaaccaagccaagcaagcaatggaagatgacaaaaaaagagttgcctgttctaaaattaatctggaacgacacctgaatgatttactgctcttattgaaagacagacaatttgcttccatacaggcttctgttttgattgtgtgcgaaaatatatttaaaacgataccagatgataacctaattattcaattttcacatgctctgctttcagttttacttgacattgaaaaggatttaaaaagctattcatcagaaatattagagaaaatactaataaataggcccctcgaaaccagtagattattagtgtttaaagacgcttatggtaatctgaaagagtttttaaacgccttaaaacaatcactttttgccacagcggatgttcaaaacaaggctgattttcttatccaaattttagattttacctataaatttagacataagacaaataaaggtaaacttctacattccatttataatgaggatttcaaactatacgaagaaacattaacagagttaagaaaaaaagcaacagatgcaaaagagtcgttaactaaactttttaaagcatccgaacaaaagatcgagctgtcgcgtacgattccgttaaaggaaatctacctgaacatagaaactgttaatttccaaggttatggcaacgtagtttttcgagaaagtgcttttaaacgcgcaatagaggtagaaataaaaaattacgaaatgaaattaaacgatctaataaaacactttaattcacacttaaaaacaaaaattgaccacatacagattcttaatctatcttttgataacaaatggaaagattttgtctccaagtcaaaaatatctttcccaccagaactgacaataagttcacaagagttgatcaaggatcccattaaagttataactgaaactctaaacaaagcctcaaacgatttagcgtatgtgattagtgagaaaatattgaagtggttaatagtttttgtcaaagaactgaataccttttttgtagctacaatgtcagaatttggagaagttatcccctttgactataaacatttcagagctttggaatacgaaattaattctaagtacatagagattgaaaataaaataatctgcaacgaaattatcgaaaatactgacaatatagaaaaactctcaaccttgataaaacaaatagatccaaatcgtattgctggtggtaaacagaaatttcaggattatctgagcaaaattctaacagctgaaacgaaccagcaacaaacacgctataaagaacagttaaaaaaacagtactttgaccttttagataacatcgcccatttccggttcgcattcgattttaaccatcaacaaaatttaattttaaaactgaaagacaaattcaaaactcttagaacagacactgtatttgaaagatttccaaatttagatgatacttttgtcagttcaatgaatgtcgagaactttttgcaggcacttgaggctttaagccatttcgtgcaggcagcacaaaattttctacaaaacgttttaacagagcaagcggatttatttccacagacgaatttcattcctgtcgaactttccaccgtcaaaacaattccaaaatcagatataaatttacgtatgaaaatacacacaccccaaactttttttcaggttgattcagtttttaatacacagttgatagttgatgagaaaggaattccagtccaattttacaatgttttccacaatattgttttcaagttttttgctctaaattataagaaaattatcgtacctgataaagtgctgaacttagtatcaaccaagtataagatcttaaccacattaaaaagcattctgagtgttgtaaaaagcttttggaaagagattataaatttcgatttaacttcttatttccaagggaaagcagaatttacttttcaaaatgttttcccaataattaatcttaaaatatttatttacattattactcaggcctggtcagtcacatctgatgaaacacagcattcgtttgaactgccactagaaaaattttctcttttaattatagcaaataatccagagtttctttttggttctctgcagtgtccagtggacctagctattaattctctaatacccttattggaaaagaaaaaatatttcactgcatttaccatctctgacaatccacccaagctatctatggatgaattaaaaattgtgtgtttggatttgaacacctggagtgaaataacattagaaaaatacacttttaaaaagaacagtttgatgcagttatgtatgggcaaagagaaattttttatttaccttttatcagcgttggttcttcctcaaaattttttgaattacatttggattcaatacaaaccttcgtgctgtgctcaggattcattccaacaactcattcaagatttatgtttcgagtatacacaccagaatcacataaagcccatttcattaaatctccaagaaccaaatgcattaaaacatggtgaaagaatcctttcgaaattcgtgctggaaaaaaatgcaaacacttctctttttagtatctttttaggcaagcagtttttattagattatctattattttcatacttaaccgcaactgaaatgactttttcatattatgtggattccatcaaaaattttcttcttacgatccgacatttggaaaatgtccagcaaaacgtagactttagaacgatattgcaatctcgaaatttcgatctaaaatatcttttaacacaatcatggacacaaaatgttttagaacagtccatctttcacgtgcaacttgataaaatcattgctgacatcaaacaaccacaactaagtctgaagaaaattccactggttttgtttaacggtgacaacgaagtcgtgtcaacttatgtgccccctgaacaagcaagccagacagagcagagctttcgcattaagaatattttcccaaatcctgtgcaagagtatagtagcaaaaatgtgattctttttacgaactatccaaaaaacaccaaatttttatttaactctcctccacctaaaacagcggcaaaaagttacaaactaccagacactaccgatgacataaacacggaaacattatcaagtcccacgattcaaagaatccctatcaaaggacttgtacccaaagaaaacgaaattgtctttttaccagaaaaaaacactgcacacacagactctaaagagacaaaaacgcatttaatagacaccttcaatatattgtctcaaacaaagggtgaaatcaaaacattttctacagattttgatcaaacaatttccaaattaaaacatttgtacttttaagatgattcgctaactttgctatttaatctatgcaaagcaagcatgcgtaaaaaatcaagtctgaaggctgctttttcaatgtttccggtattttgttttgcatattttgctagaaacgtccctgtgacagggtgtgaacccatagaagaatgcaagcctagaatattcgtaaacatttgttgctttttcttttcttcttctttttttgaactgttgccagaaatctggttgatttgagcagtgatttcatcaccacgtgtcgcagccatgttgcgtgcacttagctaattgagaaattttacagcctgtacaaatttctccacagtcctctagatcaagacacgtttctctgtagatattttgacaatcttggcattgaaattctgtggagtgagaaattagtttcaacagtttatttatcgttagattctgcagatggatcatagagtaacaagttctgcaagaacatgcaacaatggcatcaaatttaacactatcgtttaaaatagtgcaagcggaattagttccaattatagctttccatgatacactttttacttgaatgcctgaaacactatattcatacaattcatatactttttcaagtgtcaaacgttgcccgccacataatgaacaataaagcaaatctgtgtgcatactgtaaataatatttttttcctgtctatctcgataataaaacatcgagcttaaagaaaaagtttgtttccctttaagcctctctttgccggaatttaaacaatgtccacatttagaacatatcacagtgagataactatcaattttagcatatctgagacactttgttttgcaaaaacataataccggtaaagagatgatacttgaagttaagcttcttttcaagactgtcgtcaaagcaaaagttagaatttttggaagttgatgtttttcttgtttgttcaaaacaatcggcaccaagttattattttctagcgggattaaaaaacgatcgaaactgtaacaataattttctatcatggccatggccatagcaaagataaaatttccacatggaactgttaaagaacaaccatgaaatatatcttgatatgtcaggttgcttgctctatgagcgtatcgcagtgtgatgtcattacattgttcaaagttacgtaaacaaaagagtttcatacaaggaatattacaatgagttgaaattggcaacattaactgttgctgaaataaataataatagagatcattaaaagacacaaacgacggtatttccaacaactgatttaacttatgtattgggtattgtttgaatctctccacaatttgtttccaagtaagacgttgaattttgtaaagagccagaatttttagaaccttgcattgcctgtacaaaaaatacaaatatgccaaaagcaaaaagaaattttttgtcatcatcattttattaaaaatagctttaatctgatttcttgaatccagatcacactttaaccaaacttttaaaaacttccggtagaaattatcagttaaatctttactcaaaaactttttattcgttacgaacatcgataatacgcaattttcagatttgctgacatctccaataagaaataactgcaaatgactgtacgaaccatgtttacacagcggagaaatcagccgacaaagcaaattccttaaagatgacatagcatacaattagtaaggcggcaaccaaaaaaccacaaagaatattatttctccgtgcaaaaataggaacagtaactgggaatactgctgcgtcttttgtgtttcccatgtaatttatactcctgaatgatgtcatctctcctactgacttcaactgtaacctcaatggtttttttatgtgccttgcagctctatgtttctctaaatcttggcgctctaaaaattttttctttaagattatcgctttaagaagagcgatatactcagattcactctcgggaccaaaagccacaaattcaactataaaagccgcatctcggtttcgtctaataatgcactttgtcagtacaccacttgaagaaggtttaatagcttcaatgtcattcaaacacacagataaacactcattgacatttaagatgttgcattctttgacaatgttctgactttcttgttttatgggagcgtggagataacaagacatggaaacagcacctcccgtatttttaaaaataaatctcgcttcttgttttgtcaaatcttcccagagactcagcaaatattccaggctatatgcaaaatccaattttaaaagtatatcacataaaggaaatttaggatttttagaaaataaatttttatctgtgacacgaaagtctgcgggacccaattttaaaacgcggcacgtggaaagaattaattcatcgtacatcttttctttcaacatgtttattttctctttaaaaatttctgcagttgtatattatgtatttaaatattcctgatgttctaaaattccattcacatttaacagtttcgataaaattgaagtgagtagtttgattttttttttgataatctccgagtgactgcattgatttgctctgtgatgtaaatattttaaataggttaagtgtctgtatccaacattaataaaatgtagtcgggcatctaatgaaggcagcattatatcgtacagttttggtaacatagggagaaaagctatttcaatttcaactcgggaagataattgttcataaagaatttctatatctgttttggcattgtcgttagacatggcttataagggatggaactccgattccttttctatgaactcagaactttttaatgaaattcttttatatgcacacttagattcaagtggaatagattctgatgatcttaacacaaatcccaatacacttgaaaatgaaattaactccgttgaaaaaactttaaatattgaagaactgaaaaaaattacaactgctttaaatattgacaaccgatgcaatatatgttcaattataaacatctgtttacgacatgaaaccgataaaatgtggatctatgactatgctcttttgtgttacaaatgtaatgctgcacctagaactcccttggctgtcgtaataatcgccaccgaatttatgcagttgattcaaaagcatttcttaaacataaatttcgatgggttatttttaaacaacattttgtcaatactcgattttcatgtacactttttcataaacaggtgtttctcaaacaccaacgatgatctattacataatgaaaacataaccttatatcacatggccatattaaaatcacttctattggaagacgaatctataccaaatataagaataaagaaatttaaattaaaaggaaaaccaacgaaaaaacagcatggaaatgctatccttgaaaaacaaactcttccacttaacacgcattttacacatttaattttttatatgtgggctgggacaaacatattcgatcgcatttcactaactgatctagccatcaagaaacgccaaattttaaaagccatttactctactaaaaatgagctcaattgttctgcgggaccaatcctactatctcaaataccgatctccatcactaagaacgccaccagtagcgtatgcttattatgtgaactaatgacatcttctcagaaaaatttcgacttgctacagttcatctacaccagtgtcattaattactgtcaaaataatttgaagatgattgacagaattcaattcgtactcgcaaatcttttagatttagctagaatatatactaacgttaaaaccacatcagattgctcaaaaattgtattagccaatgaacaagaattttcaaactctgattttgtaattgattgtcatagttttttaattctaaagcaggttggacctgtgggattatacaaacatttcttttgtgatccactgtgcatagcaaacattaagacaataaaaccccatattttattctatacaacagaaagctgtatactacaagacttcaaagttgcaatttgttatcagaatgagtatttaaacagtgttgaaaaacatgtttggttagccattcatttttttaaagcatttcaggtttcaaaattaaaccacaaaaataaaacgcttatatctgatttcttaaaggatttcacacagctcttagcagatcaaaactttgaaattgtcgatcctacatttaccattcattattacgtttagcatggctattcaaagtacacgtagactgagacgagcatctagcttgttaaagaaaagcaaaccttacaacaaagaaaaaactaacttatctttatctttgtcacttaaagaactccattcggttttcaaattatttccagagtatgaattgaaatttctaaatatgatgaaacttccaataaccggtaaagaacctatcaaaattccattcgatctaagtctacatcatcaacatacgtgcttagacttatcaccatatgccaatgaacaagtttcaaaaagtgcatgtgttaattgtggtacaacaaacattccaacagcttcagatgctatggtggcatatatgaatcaaatttcaaacgtaatgcaaaatagattatattactacggttttcagaaaaaggttgaactgattcgtatgtcagccaagcaaccaacgctttttcaaattttttatattctttcaagcatagcaagtaattttttaccaatcatgtttgaaaataacgagaaattaaatatgtatgttgttttccaaacaagaactcttcatattccttgcgaatgtatcaatcagattatgacagtctcttccggatacactgtacttttagacatcttacacgacagcattgtactacatgttctttgtaaaactattgagactagcaatattcaaattgatattaatgttcttcagcgaaaaattgaggaaatggacgtacccgatgaaataggtgacaagttcgaaaagctgaaacacattctaccgtttatttaaaacagatcacagaacatctgtcaggtcacaaaagctttgatctacatatacttttaaaggtaggattgaaagtaaaaacttttctttcttaatgcccgttttcggaaatattggagagatagcatttgttacagctttcattatttgttcaaaatatttatctgcattgatttttaagttgttctcaatagcatatgctggatcttctgctaactcataattatgaaatgttttttttacggtttctgtgggtgcaattaaaatgtacataactctatctcctatgtttggcaactcttcctttctttgagctaaccttttaacaacagccaaatgtggtaaatttgcttgcttgtaggcagaaatgtcttttgataagactgaagacaaaaccaaacttttaatgttaaccctgtttaagaaaagtgcgtctcgtgcgtcacacaactttttaattattttttggataccatcgggaactccattttcatagatttcttgtattgtcatattagagagcttttcagcagacttttgtacatcgacatcccaaaagagaagatcgatgatgtctttaactaccactttaacaaaatcgcaagaagtcttgcgaactaactccacacctttaaaaacaagcgttgcatcatctaactttccaatgtaacgtttcttgcatattaaaattaatggaaataggatcttttcaaattctaatttgataggatgtttaaataacgtgtttgttatgtggcttgcaatagaaggagctattcttttcaaagctttgggacaaacatttttgaaagtaacaaaaagactgtcagtatcaccataaatcacctctattccaaatgtccctgaaaaatcaccgcgtgtcaatccaaatttctcaatgaaaaaagtgtccgaatacatggcgctgtcaacgtaatcaacagttttacaaagcatttcacgcccaagacatgtgacagaagctgctattgccacacatggaagtaagctatgtgttgccccggtgactccgtagactgaattacaagtagtttttaatgcaagctgcttcttatctaaaagcatttccatcacggggttgttacacattttcatctgcatttttacttcttttcttttatccagccattttttcaataaactcgctaaaattgattccctgactgtctttttaacaaacctgtgcgttacaggtccaacatgcacagtgagaatgtcatctgcatgtaaaccaattactgcattttcatcaacaaccagggtactataacacagattatgagccatcataatacttggatacaaactttggaaatcaaaaactactgttggagtagcataataacctattttcggttctaaaactgtagcacctttatagcccacattttctttgcctttattaaagttagtgttcatacttggtaaaatcatatttaaatttttagcttcgtgtaaaatgcatgggaaaatttttttttgttgtccctcaaatacggcgcaacgaatagtaatataagcgagacttgcaacctcagccatttcatagtgataattaatctttgtaaaaagctgaacaaccaatagagaatcttgtatacaatatctgccaaccacagctctacctttggaaccatcaataaattttttaggaatttccttgtaagagagattttctttttcctgatttaaacaaagtttggctatagtgtctaatttataattctgagctgagattttagatgaatacacattatacatgtcgaagcataaaatcccagacatgttaactttagttaaagaattcaaaaacttcttatgctgttcgtagggaacgatgacagaaaactttccacgttttagtttcgaaaaaccccctatctcgaaattatatattttttccattctcgtacataaatactttaaatcgaaattgatgatgttgtatccagtaaggatttctggtgatttacattttaaaaaaaggaaaaaagcatatagaagttcaaattctgatgcaaactcatagatgaataccccttcgatttgctcgcaagtgcccaaagtaaacaaatgtttactttggtaatttccttcagaatcaaaatcgatgaccgaaattaatgatgatgtcaccatttgctcagcatctggaaagtttccattttggcttagacattcaatatcaaaagaacaacaatcatataatggccaagaatcttcctttaacaaaaataaatctgacacatgacaatttagttcaatttcaacattactgctttttgcaaattcttgaatagatagataattaatttggtaccaaccaaagctttttaagttgttatcaatgaagaaacgattgagaatctcaacttctgcttcataaacagaaacgccctcatttagtaaaatttttccaattcgattactgatataaaagtttgaaaatgataatttaaataaatttttgataggttccgtgttataaccgtaaaaattgtatttagttacagattcaatagaaaatgagcatgacatttttatttcagaactattcagaagtgaacagattctagaattcagctcttttttacattgatattcacagtagaaataactattttgtccaaatacattgatacaaacttttttaccacattctgtttttccaaaaagttttatgacattaccagatggaataacgaaatgtctatattggaaagggatgttttctatagaatcagtaaataataaagattcggatgcatcatagatatgaaattttaaaggcgcacgcaattctttttcggctacttgagaaagcgatggccatgtcatatcatttttgagaatgtattgcttatcttgatagaacattctcggttccgagtcacaaagagtcttcattaagccgggtgctccatcgtgcattataccgcgcggaaaaatccggagaaaagtagattttgtttttttcttagttcgtacattctctagatacggattaaagaaggacaccagatccatcacagttcttctgttgaaagtttctgatagcccctgtattgaatcctttcaagtaggcttggtctctgtgatttttttgcctcagcgatttccgcttttttatatgactcatctaataatttaatagctttcaacatttttaaagcttccacttgtgaatattcattagtgtgtgttatgtcatcaccttgcggttctgtgtctttgttagtttttaaataaggcggagatgaatctaaaggttctttcacttgcgcttgaaccgattgcgttgcttgaagtaccgaatttgttgattttgatgtataaggaaataaaatatcaatcggtgtttgtgctaatcgtttatgtcttaaaaataagaaaataactaagccaatcactcccaaagttagtaagatagttagtgctccaccaaatggatttttaagaaaagagaaaactccattcaccacatctcccaaagcaccagccgttacacccagcacagcccccaaaccaagaccaagagcgccaagacctttgaaaaatgtgtcaatccctcctatatatgttggagtaacagttgcaatttttgtttctatatggtgtagcgcacttttgtaagaattgtattctctaagaatggtttccaaatcaaaaacgttcgctttgctcagttcatcttttgtatacaattccaataatgtaaaatctgcattttctaaaggatctatgtttaagtcaacaaacgcatctaaagcttctatttctgttatcaaactagaattaacgtacgtatagtctttaaaaatatgagcgaatttaccagacaaaaaaattttcgtgttagattgttcacattcttctgttctgtgatttcccagtaatatctcattgtctaaaccaagttgtcctaaataagtttccttcgaagaatttgcaaatgaatatgttaacaatggccgagaataacatcttagagcatcgtaacttgaatcttttgtcaatctcatacttttatgtagctgaacagaagtctggttgacttcaatgcactttgagactgctaatacatcaccaattaatttagcggacatgggtttaccgtacactgctgaaatgattccagaaggacttattttactaagctcgtgcaacactgtgatagtgcgtttttgatttaaacaccaggcttcagcaagcttacctagtgctgtgttaatgtaatctttcagagtgtcgtataggtattgtagttgaacatatacaatgtctttgttagtctctaattccctcttcctcctttttctagaagcattagaaaaattttccaaaaccgttaatttccgttgtattaacggttgccaaatcagaattaaatctccctcagttttaaaaatttcataactaccatttttgtcatgcgaattgttgtattgcgtttggtaaatctcatccaaaattgaagtataattgctgttaatacaattatattttgaatcagaaagcgtataattactttttcctgtgacaaaagaagcagttagttcctgcgcaataaagtgaaaactgttagcattttctgcccgtaaagcgtgtgggattgtcatccaatgctttaacaaacaaatggaagactcttcattctgcacttcccatgaaaaaatagtatttcccttttccagaaaagccattttagttaacgtcacaaaatttccttttgatccatcatcaaacgttttcagcatagtataattatttctaaacaaaattttttccgttggttcattaaatgttttagaattaataccattataaaacggtgacccttccacggtttcccctgttgataaagcaaaaaaatcaaaaggatatttagtctttgcaatgcagtctgtaactatgcaatttatcgatgtagatgttgaataaaaccagaggggaccatttcttaaaaatggttctttagtagttatatatcttctgacagtatcagatttaaaatttaacggaatcaaatccaacgttttattcacatattcatctttatgatatgcaacatactcctcttcctctgaacgttttacagagatagaggacaaacaacgcgcctcggtgtttaccatgtgcacttcttcaattggcattggcaaagttgtaacagttcgatctaagaaatacacagtgccaacatcgcgatatgttgtttgaaatgtaagttcttttttaaaagttctgacagaaaacgtgtgtgcttcaatctttgttttgtaaattatcaaaataccttcggtagttttaatgttagagccgtaagacgcgcaagaaacctccctgtcaaaacgcactaaatctgtcccggtggcaattgaacaaattcgaaatggtaaatgctgattgtgtccagtcatgacaaagtcagcttctgtttgtagagatagctgtaagctaaaagttataaaaacactcaggaatagaattttcattttgtctacatagatctaacagatttggagccggtatatgggaaacttgcttagtttgtgaaatttgaacaggatcgcattgagtctttaaatcgaaatacaataaagagtacaaatcattaaattttgtcgtggtcgttccacgcttgaatagtaaaggagaaccactatcaaaagttaaaagtattttttcgacagtttctgtctcttcgccaaacttgacgattgataattgttttccaaatacatcattatatagtgcaacagacaaaactaattccctgataaaattccacatttgtctttgcatatcgttgatattatgcaaaccatcaaaattgaaaaatttattatatgtacacagcatccaattttccgggtagatcgtgccttcaacacatttagccagatcttctttcatatgtggtaaaaaatctgcaacatcgcaagcatacgccatggatatgttgctggacaatggaaaagaagcggtgtgataattcgacaatggaccagtcaacaatcgatacatttcttgacttaaattaggtaaaagttcctgaggcaatttttttgaaagtagattgtttttaatgtataagtgatcatcataagtaaatggatcagcagagaaattttctagtgactgcagttgtctatttgcaaatgcgttcatcattttcgaaagactttcgaaaatgtgatttcctaggatattaatattcattaacttatttattaatgcttcttgctctttgatacacagcattactttactataacccgattcggaaattttttggtaataagctttttttctaatgtgaatctcttgttgtaaattgtgatcttgtgtcattgaatgcgttacgtatttttttgggacagtttcatgagctgaattttcaagttcatttaataaagtttttattttagtttgtatttcatcttcctctgccagctttgtaaaaaccggatcttcttctaagttttttatactaacattggtaataatatcaacgagtctgcaaggggaaataaatctcgatccgatgtataatttgtcatcatttgtaacattttcttcgttaaaattgaaaacatcttgaatagtttcaccatataaaaacttactaatttcattttggagatcagcataaagtgaatgacaaagatttagttgatttagagttattgaagctttttgaataacagattctgaaattttagaccaataggtgaattcactcaacgaataaattgtatctggaattttgctaaaaaggtcaaagttgattaaagtgttttcagcttcttgtaaatgtggaggttttgaatatagttgctgttgaaaaatatttgtgattttcgccatatactcttttacaagaccatattgttttgtggaaaaatccaaatctttctcaatgatgtcaacgtttttttctaaattggataccatatgtgtttcagttagatgattacaaaatttgccagctagtcttttacgaatagactttccttgattgggcactaaagataattcttcataacattttaaacatgtagtagtttcagaaaaaacttctggcttcatcactacgcaaacgccacacaaaattgttagaaattcaataatttgactgcaagcattaatgccatccagtggtgaaattaagccaaaaatacaattcatcttacataaaagtttttcaatatcattgatcgtagaaatgtctacagaaaaagtcaaataattattaagagccaagtccaattttaagtgttgcttgcattcattgagttggaatatattttcaaaatatttttgtttgtcattatctaatagaaattggtgaattgaagcatcgagtaataagacttgattatacatagcttttaataaaatctgtaaataaatggttacaggagatgcacaattaaaattttgatgacagagttcagcaaataatgtcttaaacaaatgaattattacaacaccgtttttcctgaaatttgtcatatctggaataagtgtgacagggtcacaaaatcgtaagcactctaattctaaagcacattcacttaaccttgaacacaagacacacaatgattgcaaagaattcatttttacaatctagctttttttaaggagggttcctcattttcatgctcagtctcttcacattttaatataccaaaaccttgctcattaccttctaccaaaagttctgaaaaatcatagatggcagcactatcttctacttgttcttcaaaaactgacaataaagttgaaagagaaaaatcatgtacatttaaatccgttaaatgctgaatcttgttcattacggattttgctagaggctctctaccatccacgtagaataacatatcatccatagtaggcttactatctctatctttcatcacttcagctaatatgagtagttctggatttacagaattggataaactttcaataatgttgagcacctttcctcgaattacttccacatcataaacaatggcttctctcttaactttcttcacaataatgtcacacagttttgtagcaatcacaaatttctgacgcataaaacggaaatcttgcaagccggaggaaggagggtttaaattgcgatctacaccacttccagctatccaacctaactgaccaaagtggaaataatctctactagcaacactcacaaatttttcgatcattaaaccaaaggtaataatagatcttcctgtgaaaatgctcccaaaatttggttcttttgttaatgatgcagtcataggttctttaagtccattccctaccaacttttttacgtgcatgacgtattcctgcacagaagaaaatgttggatgttctttaagaaaaactgggaataacatagggttttgaggaactagtttagaagttaatgcatgcaaacttgttagataatctctataaccaagaactgataataatttattatgaaagtaatactcgataaaggatagtaagcattctggttgaatatctaacaaatctatttcatcatatgaattggtgacacggaaagtaaacttgatgaaagaacgcatgtcttcaacattacctatatctatggtttttggcatgttattaagcaaaatacgctgccaaaattctaggcaggatatttttaaatttggaaagagccgttcatgatatttaaacagcaaaaatgataagcaaccagaaagtgggttctttttctgtttgacctttttgaaaaaaggattattttgtgtgtttttgtttggcttattgaatggtctattttttactcgaaaatctttcaaacattgcatggaaaggcgacagagtttagcttggatagaggttttagcatatttacccgatttaaacaaattgaaatcaatgtattgttccatgtctacatttgaggctatttttacagttttcatattcaaaaaaccttttttaaaatgactgttgtaaaatgctccgtagagagattggtattgttgcattaaccatttagaaattaagtttccagtacaaggcctatctacaacatagcccgtaccgattattaaagccaagttctgtaaaacaattagtataactttgtaatacgtgaaaacaaagaatggagaaaaagccaaagacagaggtgtcgtatcaatgttgaaagattgtagacagttttcgatttgttctctggatgtctgcgtttttctcatttctgaaatacattttgaaactgcttcctcaatgcattgaattaaatcattaatcatattcacaaaatcattttgacttttaaaatttaaattgtcttccccagttattgcatcaatcaaattatttttcttacaataatcgtgaatcattcctaagaatttgaatctatctaaggaaggtgtggtttgagcttctttcattggatctttgctttcattaactccctttttcccaaaagaacctagaacatctacatctgcataaaaacgagaaaacattgtcataacaataggttcttttttagtcgttttagaaatctgaggtaatctgctgttgattctgatcaatgctgttccgatacacgaatggcaacacttaccttcacaaaactcacagagattagaggaacaatttacgatgtggttatatatttcagaatttccacagttcgtgttataaatagacattctgttcaaattccatattatatgcgataagatttgtggacatgtcgcacatgcgtaagctagatgaaaagcggaaaatttatcttctttacaaggtgaagaattacactttatcaattttctggcatcgttataaaaatcttcgttaagagatgacaaggaattacaaaactggattgaacgcagtaatgtttcttgagtgatcgcagagttaaaagcttgttttgtgttagatatataggccaatttgttactgtaaagtatcgaattcgcagcaaagactaaagcagctacatggctagatagatggagcctcaattttttcagttccacgattttctcttcgtgggtttcagccgatttgatgatgggccactctgaaaaattcatgatttgattattttcataaatagaatcaagatactctgctgtgtaactgaaggttagttccgtgattacagcgtccactaacattaaatgatctttttcaatcggtgatagtttttgaccaggaataccgtgatatgttttattcggtgcaagcttgacagtttgttcagtatcttggataaattgtttcagaccggctttaatcaattccagggtattattaaatcgcaaagtcattccccatgatgtaaagattaagtagaacaatacttcgctgatctgaggcgcataaaagccgttttcttgaatgaattcagtgcaagtatcgatgcacaaagtttcttccgattcaaacaaggtagccgaatataacggaatttttattgccaagcattcaccaacctggacttgaatctgctcttctacacatgggattaataatccagcaaataaaagttctttgaaaccattcccaacaactatatgacatagaacgtcatctgcatttcttccaacactttcacagatctttcctatatccacagactttcgatttccgttaacgacaaattcttgtagattgaatttttctcttgtttgtttgcacaatttatcaagatttccatggtcttctgcttcttttaaaaaaacatctgtaccgtggaaaaagaagcatacaggcataaacgatgtgattttggtaatgactgttccgccgtaattaataatgggtgttttaacggttgggaagaagtcattttcaaccgttagattaagtaacaagggtgagatcactactgattttcttttttccattaacgataatgtagtcagaatttctattaatttttgttctttcggcagaatgtacagccatgctgcggtacatattggggccgaaacaacagtttcattatcatcagccattcttgaaacatgaagaccccagtttctgcaaggggtgtttctgctaaaccttatatattttagttgacgtaacaaaacttagcgtcatcatacaacggaaattaagttttctcgttctactgttttagtgcggagaactaaaaacgatatactgactcggatttgatagtttatgcaaattagcgtccacctcactcgtaatagtatttatttttcatggtttttaaaatagaattgcaggcaaggaggatcaatgaaccctcccacttccgcaaagtaagcaacgaccaatcagaagtttgcattgcaagtatttaatttgttgcagcaaagcattagctagaggacagccacagagatgctacatattgggaaattaatccgaatcatcagaatcagtgtcattaatgtcggtctcacaagtttctacatcttcataatctaaatccagttccatttcattatcagagttttcctctccattgttttctttaattttcgctgatttcatagaagtatcattttcaataaatacaaagcgagtttcatcttcctgtagagtcgtgtttgtttcaaaatctatagaatcaacttctttactccagtcttttttcagtctgttttcgcgtagctcatttgttttctgtcctttattcgttttatccgcagtaagaagctttttacatttggcttgctttttggtttgtaaattcaattggacggtttgcttagattgctgtgaagcaaagctgcaagacggagttgtagaacatgcaacattaaagctgttgtactcttcaggcatgttaggatgcagaccaaactccacaaattctttgggaagataggtacagaaatataagcttggtttccaaggtgacatcatgcgttggattctagtttggcaaccgatgtcatcacattgatgattgttaaattggtctccgactaatctggaaatcatgccacattgatattgttcacttacacgatcttggtcaaaatcgcgtatgaactgaggttgtttagtttgaagaatacgttcctttatttgacgtaaaatccttgcaaaagttactataaatgataaagcttgctgtgctggatattgaaaagatccaggagtctgttgctgtacttcatattccgtgttaggcatatcacggtcatataccggttttccacaaagttgtctgaaaatacggtattctatgtcaccatgtccattgtcattaaaaacacaacaaagttttgccatattcaacttgttgaagtattcaaacttcattatggtaatagtatacataaacagatcttgagggtcaataggtaagttgtgcacaaaatgatatttatagtaaatgcaagcttcctcaataatcgcaagagaaaatgctaacgatggagaattcgtcaatgaaaaaactcggtctccgagtatctgttgatgttgttctctattgagggagtttaagcagttcttatatcgtagtaacaagtctgttgtcattagttcttctttttccaaatagattttttcatgattccggggaaatcgatctcgaatcctatgagctggatctcgtgcttcaccggaatacttgcgtaaaccaagggcttccgcggtgtagctagagccaaaaggtgctgttggtaaattggcgaaaaaagtcaatgcatgcgtctgtgcacgcttttcttcctgcttttcttcaatgatgagtttcagctgttctagttctctgagactcaaagcgtctaattttgattcatcaagctgcttaataggaatgatgcgtctgtgaaattgtttcgtaaagcggctgacatacttgttagcaggtttatgaacaagagttcgtttaatggttttcaaaccatatcgttgccgccctaatacattctttttaaccccgcgtggatacatgtttctgtcgaaaatgagaaccttgttcataaacggccttttatattatttttgtctcgtgtagcggtgacgcctctgtggtttttaatataaggaacatttgacatataaagctagacacgaattaaggtgcgtctaaaattttatttacaaaacacaaataaataacataaaaatgtcacatattcaaagaatctaaaacgacagatgaatgcacttgcttactattagatttacatttcgtagtaaaacatttgctccataatattatcaaaatgcgattgttatctaccttaaattctaagtacactaagacattttcacggtttcccttatgattccttgttaaacaactgaaatcacttagttttccgttttgcaatttttttagttgtatatttttgtgatcaatttttagaaaagttacatgttgaaattgtgtagctgttcgtgcttcacagtgttggatgttcttttttaacatttgtggccaggcaattgaacgagtaaaagtcattaacaaatcatcacgggaaagacaacttgtttccgaaaaaccattgacatgtaaatatttcaaacataaagtctccagtgaactttgttttctgtgatacagttgcttagtcctagaatctataaaagaaaactctgttggacaggccttatcaaaaatgctgtagattatctctgtaatggtttggtctttagttccatgatgtaaaatattattgagatctagttgcatgctaacgaaatcttgaaaattctttttcattttttccgggacaataaaaataggcttcagacgaccatacaaaaatctgttattctcttcgtcaactttatacatgaaacctaaccgtaaacaacgtcccgtattatagattcctgtatcaaaacattcaccaggaaaaataaccgagttaagaatctgcattaaatcgtggtttagacacattaaatgattgaatattttagaaagttgttttaatggctcacttccaattattgcagtaccttgagggattggaatagcaattcgaagaccaattttttttttgcaaacacaaaaagctgtttcaacttcattgtaacatacattgtggttcaggggattctccggattactacaggtagttttgaaaaaaaagatggggtaggcgtctttgtcaataaacggaaatattttttgccatgcattgatcagcacattccgcatcaatttacacatagagaaaaataacgattccgttattatagctgaatcctgtaatggcagatctaaatcaccaatataatttgtaaccggaaggtattcattaaagatttcatgcctggttacgtaaaactgtttttctatttcgtcgcttaaaaaggtcgtgtcctgcaaccaaaatgtacttgttaaagattcatccgaaatgtactcattgggtaaaaattgcataacctggtcgaaacccatatttttgtaccaactttctgcacttccaaaacaataaagatttttgtaagacatttgaactctaaacataggaatggggttgctgaattggtcatgtagatattgtctccttgtaacaggtttaccatctatcaaaatagatttattagatgccaaaatttttaaaaatccttgtaagcctaatttaattggtgtaaaatacccttcaccgtgtttattgcatttgttaaccatctttgaaatttggtctgaatttattacaagcatgatatttctattactgtttatgtcataaacgtactgttgcatttgaaatttgttgtttaacatcctttttatttctacataattttgaaaataactgtcttcgttaaagtactgtttcatgattgaaatgagatccgagtgtaaagaatttcctaggatgtacatattttcctgacattgagaagtatcagatctggtaggatcataagatgtcagttgactatacttgatgaatttatttttttctaatgctgtactgtaagcaatgtagatatagtggactcgaaaactgtttgtgagatgcacgctgtttctaaaaatatctatttgcttatcaagataaagaaattcttttcgatctcttatgtttttttgttttgcatattcagaaaaactaacaaattttttccgatagttagatttcaaagtaatattaatgaattcagacatggaggaataagtaaataccatatctcctaatttatcagtgaaacactgaacataattcttagttgttgctatggtgcttttctgctcttcaaataaataataatacatcgttaatagtagcattccttctgtttgaccgtatgttgataaaaaccaaaacggtgacgtgggtaagagatacttatttgttagatgtttaatgattatagtcttgcaaaaaaagactaagcttttaaattctatattttcacttccttctggaacatgagaaagtaaaaaatctttatacagattttctgtttcttccgtatttaaacagtgaataatatcctcagacttaatgggtaatgcattttttacataatagctgaaattcaaagattctgcgtcgcaaacaaataccgtctcaattcttttggaaaacttgcatttctgtgtctgcatacaaaaatatacattttttgatggtttatatttaacgattattggaaaaattaaatgttcactagggttcttacataagatatttactatcacgtgcgcggggtcatattccgttgcaaacacagtaatagtcattgtgaatgtctttcagtttatcttccaacagcttttaatataagacaataggaatcatgggaaattgctttgtaaaaaaaatctcttctgacatcttcaactctaactaccagatgctctattctgagctctcagagcaagaggatttactggattttttagagacaaaatatacagattttggaattttaaaaaccgatattctcaactatgaaagagactccgaaacattcaaaactttgttgcaagtgttacctatctataaaaaaacaaagctgaggtataatttgattgaacgctgtttaaataattgtccccctcacgttaaagatgcattgattattgaaatcatgaaagctaagaaaattttagagactctggatgttgtgttcatgaaaattatgattggagaatttacaatttgcagtgacaatgtgaatcaattgctcaataaattttcaatagaccaaacaacattatgtgacatggaaaaaataaatactttaattgacttagacgaagaaaatagcaagcgtcttttgacagagatcgatcctttgttacatcaagaaacaggcctgtatcaagcgctgcctaatgcagttacggatccaccaagcgaacagagagccgcaactaaaaaatgttacgaaggatttaccaaataaaattttattccgtgctgtactgaaaccaaagcatcgatgttttatctaacactgcaagctgattcaacactcgattaggtaatagctttaaaataaaatgaccgcatgtgaaaatgatggttgcaatacaaattcctgcttgcacaaagatcctctgagaagtgggattaaaaatctttacacttggagttgtgttctttaaccagatattagtttcaaccactaatccatgacagagaatttctttgtttgctattattaaagctttcaattcatcaggacaatcaaacatgtaatcaaaattttggattgtgtaattattggattctacatagaaatctttattggtaattagtgaaaacttgataaaatttggagaaggaaaattataagtttcccagggttccggtatatagcatggaaggatgttaatcactaattctatatcaccaggtaacaacattactgattcacttgacaggtttattaaagaaatggagataacgttttctgttgtgatgagttctgttacacattcgcagagagtgtcgttaactgttccagtcaaaatcccaaaaagtccgtcgggaatgtttagtgacacatttaaattaaaaatgcgtacttgttcacaaggcacccatataagttctctatttacgagtacaattttatttgtatttagaattacatccatccgacttttctcaaaatgatttattaaaattggaagttcgtttactcgaggaacattttcaaaaccaaatctgctagatctgtttcttggaaaggtgagatatttcttttcattgtccatatgttctgcaaagaactcatcgtaaattttttcacaggatttgaataaaccgttttgaggaattccaagtaaagaaaatggtcgttgataaaccgtcaattcagtgttcacatattcatttaattgctttgcatcgattttaggccatgtaagagagctctcttttgtttcgctaaagttccagatatcatccacatccgttacagtaaacaggaaaaagtgcaagtatctggacataggcaatttgttaagtgtaattgtttcagagattttttcagaaattattttcttgtttgtttcagatcttctggagggtagactttgcattttcgttgaagccttcggatgattaggaaaaatgactctatacaagattgtttccaagccaattatattgctggcatttttttttacccgagttgttttcacaaatgaagtcgacggggaggagctgttttataagcctacttgtcattcagatacatatgaaattattttaaaaaaattttcttctatttggatattggtcaacacatttattttattatgttcattttcattatttttaaagtattggtgttttaagactctcgccaaagaaactgtaaaagggtattaaatctatatgaagaatgtatgaaaatgccctcagaactgttttaatgtatttttctccatgcatatttgaacataaatattctaagccaaatatttttctcgtgattagtctgcgttacttctgtcaccacactcatatttttcatggtatttgttagaatatctgtggcttttgctttccatcatcacgtcatgctgtatgttgaagttgaacaatggtgtgtctgtggttgaatttgttacgaacgcttaatagaaattattgtacatttttctattagtatgagtgctatgaaaatttcctacaaaagttctgttttgagtgttaattaaagttgcattgaaaagaatggcggttgtactgtaatttctcaaatcaaagttttaaagtatgctttgtcacggagatactctacactacgaagttataagtccgtgttttgctgatttatgtgcttgtgttactatggtttgtcgtgaaaaaggtcgtaggaaatgatgaagtctgttgtgaagcttgcatgcttgaggtgcctcgagtagatggaaaaaattttgttggttcggaagtaacagcgttcggaattgctgtaggcttagtaactttggtcttattttctaagaacatcaagttccccttaaaactttgtattggtgacatgattccccttaccaaggagaagttggtaacaccaaatggtgttgacacattccgcgtgttcacagaattatagaaaaattttgaaatagaattcttgcaatctgttcgattgtaaacaaagtagtaaataaaattcgtaaaagaaaaaagttgctcagaattttcgcgtgaaaataattgagcttcagtatggttttggagatcttggaaaatggtttcaatcttgttttggctaaagttaattttaaacaaatgtgaagcaagtacttcaaacggtattttattgacacaagagtcatccatcgttttgaatgctagtgtagcaaaaactaaatacaaaaaggaaatattatctaagtaaacgtgacgttttctgtttgttttagtgggaaattcaaaatgtaatgtccatcgcggaaaattatctagatagagcatatttattttagaaaggcaaatattctttttctgggatagacggaatgaccaaaataaaatctgtttaaaacagttcttagagatgggtatgtcgcaactctgaatatatgttttttcaaaagactcataatgaaattttgcgaatttcggccacatggaaaaattcgttaaatttacaaacgagattttttcagagcaaacacttaatacaggagtccatatgatcagataactataaaaaagaaaagaaatcaacgtgaacactagcattgaatacattttgtttttcataaatgtgaattatttaggaactgtcaatatcctaaaatagttattcatttttttaaccaggatcatgattgcaaaatgtaccttgtgttggacagtatttgttcacgcgctaatcattttaatgatacttttattaattcttcgttctctaattggatttaacaacgatctttggtcgcaatcacaactagcttttacttgtctgaataaaagtttatctcatgttccagcataatatcaaaacaatctaaatacatgataaataccaaacaaaactataattatgataattaaatacagaagaactaacatgattgaaacttgacttgattttagatctaatgcggtaatttcgaaaacagagccatttcttaaaaacaataaataatgtgttcgtggattcacatcgataaaatttgtgtccggatctattaattttaatagttgcttgtcatccattatgtatacaaattggataattccgtctatgtcgtcatattccacaaccaagctttcacaaaacacacaatcgtgggatgaaatattatagattggttttatatttttcaccgaatatttataattagtaggtgtgcaggtagagtttaagggaacaacagtgataataattgtagtgcttatgacagtactcgtgacactgaaactagtaccggctaaaatatattttgaagagatggtgtaagtaatatttggtaatgtgaggaaggcagcttgttcatttgaaacacaggaaatgcttttaaacatatctaatctcttttttctatatacagaaagtgtgttcatcaccttgtttgtgtatgcgtctaggtttttataggataaaatgttgttgacaactctttgagttaaatctttgcgcgtggctgttgcacaaggagaaaacatcgtttcaatgtccatgacattatcaagcatatgtgtccaaaaatacatttccaaaggattgcacagacttgcgagcaaaacatgaatctttcgcttgatcttttcttggaagactagactgtttccaatttctgagagtaaaaacaaatttgcacgttccggttgggttaaatttgtaaacaatttatgtttttcatataatgtttcaatattgttttctatttctttccatttgttttgtggaactgtaacgattcttccatctgctaaagataaaaatgctagcttagcagagataggaattgtcagatcagatgtaatataagaataatctactaactggaaattctgaagtttttccatctcaggatataataaatgactcttagtcattttgaagcacttttctaaaaacctacccatcgtaatgatgctttggtgagtattaaggatttccaacagagggaggagtccatctcctcgagtactatatagaaaatgagttaagccgaataaaaacattaaatggaatgtgtctttgttaactggttttccgcaaaatccctccatgatataaacagttgctaacttattgaatttggctattaaaaacgagatgtcataattttgtttccaaatatcatccagaaagtctattttgagaaacggataaaatctttcaattgttgttttttttgtaattaacaggagatcgtctgagacagtctgtctatatatgaatgaactttttcgaaaaggtgctttaaaaaaaatacgactaacatttccaaagataaaaacgacatcatccattcctgtttccactgaaattataaaaaacgatggtgtcaaagctagcatgaacacagtatttaagtaattataatgtctcataacacatctttctgttattgggaatagataatcagtcaagccatttgaaagtgtgcaaatgtattggttgtaatagagtttgcgaatttccgaaacatttgcaaagtagacatccttttcataaaataaaggtaagaaagacactgtaatcgtttttgtatgcgaaacaggtttgatatttgtctgaaatttttgtgcatagattttcacagctttctctgttgatgggttaaaaaaacgtgtaatccgatgtttatattgatcaaatgattcatcgaaattcacagaatcaaataaattcgagacaaaagtatatccgaataagcatttgggaatctgataaacccgagtttcgttataatcatggaaattaaacgttattaaaccaggttgaataatagtttgatttgttttttcatttacgcaaattgaagaattgagtatattccagtgtttccatccatttattgacacgatgagaagtagactatttatgtaaaaatacattttctccaatttagagcctggaagataaacgggaagtttgttgtaggctacgccttaaactttacatattaaatacataacgggataggaatcatagagatattttgggtaatatgtctttagaatacttgccccctgttagaagacgtattggtcaatataatcatttgagaatctacaaaaaaattctgttgttaaaatccaattttgaaaaattaaatttttttttgggcaatctttttccagaagaactgcatgattcaaaaatacatgtatattttgaagttagattagggtgccgtattccggattgcattattgtttttaggcattttggtgagaaattattaaaaactttccattgttatttttttgaattcaaaactacttttgccaaatcaaatctgttttcaattcaaaaaaataggacacaaaaaattcaatatttacagggactaaggcaactacgacaagcaacagattatctacagcaatttgtcatcaaaaatgaaagcttatgtaaggtaaaccctgtaatctgcttttttagacagcatggtttaaaattggactttgtgaaaactttcatagctaaagaattgcaactgtcttccacgtttctttgcaacctttttacgaaatatcaaaatgacacagttaagtctattttatcaatttccaatccaaccaattttcgaagggcatgtcagaaatactctaatttgtaccgaggaagatatgcaacaactccaaaacttgggaattcgaaaacttcgaaaagaaaaagaagaaattcaaaaaaacaagattttaaaaaacttgttaaaaactgaacttgatgttttgcaagcacatgtacagacagaatgccagaaattaaatacaaatttaagagacattgaaaatgcattgcttttagaaaatcaaaaaataattccttctagtgaaacacattctgtcttggaagagtctctccaggctaaaactgtcacgcaagtcacaattacacaaattgatcctgctattcatttcacggaaaatttccgacctgagatgataaaaactttttataataatactcagatgtggagctatacgtttggagcttggttttacaaattaaagcgagctttctttaccgattctaaattaaaaagaatgctaaagttaacatatgttgattctctctctattacacaggaattgctgtctatttcaattaatgcattggaacaaattactatttatcctatgcatgataatttagtgtccgatttagaagctggtttgtgtctactgactgctttttttgcatcgtatcctggaactttcttaaccgaaaatattaaattcgtggatgtcattcaaaatttgtctcaaatttttagatatctaaacaccgaaattttagctacgaaaaacgcgtcaccacaggatttttattttggattcaatgatccagacaaaatgaaatattttattccgttgtgtaaagggaggcattatgcaataaatacattcagtaatcatatcttaattaaaatttttataaaaaaaggtgtgataaagcaagttcccggagatcaaatgtcgaaaggacatgttgtaatagaatcgaagttgacaggcacgttaacagatgataaattattatattggactcaaattttattgcaaccgaaattgggaaaagaggtgccgatatttgtccatcagcagcagtatttgcgttctggaattgttgccatagaatccttatatttactttggcaaattctaaactcagaaagcatttttggaaagagaactgggaaattttatctaacaacaattttcccccatgtaaatgcagaagatgttacagaaacagaattttcttctgtcaatatccagaattttgagtttctcatgaaaaactatgtcgtccccacatatttagccaataatgaaagtactatttccactttatttccggggttaatcagcatcgtagttaacgaaagtgttcgtttaggctgggatcataatcaaaatactttaacacaaactaatgctttgcatagccaaacaaaagacaatccgtttgttgaatatatccgttcacaattagaagaaacggcagaacttgcggtactcgagaaacatgataaaattctttttcattttgaaaatggcttgaatgtgacactctcattagcacttccacgacataggttgttcgctatggcatcctcattatttaatgtggctgatttgtatgatttcttgtattttttggtattaggttttattccagtagcaactgttatttgaagaccaggtgacgtctagacatttgttttggatataaatacgcgtggaagtgttaaggagcttcattttaaaaaagacacctttcttaagcttttgtaaacatgaaaaatatcgatttaacaaattggaaattactggcagaaatatatgaatatctgttttttttctcgtttttctttctttgtctgctggtaataatagtggtgaaatttaataacagcaccgttggtcgagaatacacatttagtactttttctggaatgttggtttatattttattgttaccggttaaaatgggaatgttaaccaaaatgtgggatgtatccaccgattactgtataatcttaatgtttctgagtgatttttcatttatcttttcgtcctgggcgttaacactgttggcactggaacgtatcaacaatttttctttttctgagattaaggtaaacgaaactaaaattctaaaacaaatgtctttcccaattatctgggttacttccatctttcaagctgtacaaatttcaatgaaatataagaaatcgcaaatgaatttagaagatgattactgtttattggctattgaacgctctgcagaagaagcctggatcttattaatgtataccgttgtcatcccaactttcattgtttttttctacgtgttaaataagcgatttctctttttagaaagagacctgaactcaattgttacacatttaagcttgtttttattttttggtgctttatgctttttccctgcttcggtgcttaacgaattcaactgcaatcgattgttttacggtctgcatgaattgctcattgtttgtttagagctaaaaattttttatgttcccactatgacatatataataagctgtgagaattataggctagctgccaaagcttttttttgtaaatgttttaaaccttgtttcttgatgccttcgttaagaaaattgcaacaacctacaaaatctacacagttttaaaattgtagaggtccaatagaaaacaaatctgataaattacactctgttacttttgcttctttctccactatgccacaaaaaactttgaaatcattctgaataaaagtaaataatccattcctgtgttctggtttctgttgactaaaagcaccgtgagaaattttgatcttgtcaaaaaaaattaaataaccaaaccacagatgcttacaaatttttcggataaaaggttcatatacttcttgcccccagaacttgttgaaatagcgacataattttaataaacggtgattgtagatggcaccaatagaaaacattatattcccatcgtgaataatttcagctggaattgtaattgaaagaccaaattcatccaaaaagaaactttctatgatttgtttaacaattccagtatgatgtaattttttcgagagctgagctgcattttcttcactgaagatatgtttaaggatttctgatccagatctttgtttaatcatgcaaaagatcttaaaccaaaattcatcaggtacctttcgattcagaaccactaaatcactcactccgatattgtgcaaagtctctctcaacagtaagatttggatgccgtgagaaaacattagggtacacacattctggatgatcaaaatctcttcttgttttagattaaataaagattcaccgcttaccaatttcttagtgatatgtaatattaaattggaggttgagttgttcgagattatgtattgacctacttgtgtcatcgtaataatggaaactgtgctagtggcaggcttcctatgtgtgtatgatgataatgatataaatgataacttttatctgccaaggaggacgatacaagaagaaatcaattccggaaatggtttgaatattccattgaatataaaccacaatgaaaatgccgttataggcacagtctcttctttaagtgtttacagcacggtttgtttcgttgcccgtgttcaatcaaaggaattccttacaataattaagaaaatagctgcaaaatctaagctgataaccaacacggaagaaaaaactctgccaccagatcccgaaatagagtgtttaaattcaattttcccaggtttgtcattatcgaacagggttggtggcaatgaacgtgatccgttttttaaacatgtctctatctgtggcgttggtcgtcgacctggaacaatagctatttttggacgaaatttaaattggattctggatagattttcttctattacagaagcggaaaaagaaaagattctgagcacagatcaaagctgtgttcagttttttgccgaggaacaatttaaagtggatttatatgatctgctagcggatagtttagacacttcgtacataaaagtacgttttccaaaattacagtctgataagcaacttagtggaatttcaaaatctacttatattaaagcgagtgaaaatttaacggctaacaaccatactattaacgtgaattcaaaagtcacaaaggagacagaagcaacagacagcgtttcacaagatgattgcgcagtccatgcaccagatttgataagtacgatttgctcgacaacgcacacaacgcatcacgacctagtcagaatgaatggctcagctactggcaactcagctagtcttcccgctcctcagttttccgaatgtgtttttttaccgaaagatacattttgctccttactgaatgctacagctggggcccaaaataaaaacgtaacgccagctgctccgatatttaaaactgatgaatatataactccgtacccagaatctctgagcagagtggattatggaaatagaatgaattatcacataccacctccatattggtatccctctatgcctggatttaattataaatcttatcgtggttcccaaaaacggtgcgctccaacagattcggatgatgaaatgagctttccaggagatcctgactatacgacaaagaaaaagaagcggtatagagaagatgacgatcgtgaactcactaaagacaaaaatgatattaaagaactagttgatgcaatagggatgctgcgtcatgaaatttcagcgctaaagtatattcggtctcagtctcctcagagacagcattgtacagcggtagatacaatgccaacgattgaagaaaaaaacgtggcatcacctaaaccatcggttgtaaatgcctcgctaactccaggtcaagacaggaatcaaaatttgatgcaaagtgatcaatctttattgagtttgaacaaaaaattgtttgtagaagctttgaataaaatggacaattgaatacaaattatgcgttaatgtctctgttcccactgggacaaggaaccgtttgcagcccaatgttgccttctaaaacagttaatgtgtgtggtaaggcagtgattggtagaaatgtgcgaaggttgtctgttctcatgcgatatctgactggtacaaggtgttccttagctatgtttaaatgaagagaatttagattaatagatacgttagttgcagctgtgatatttggtactgtagatagtacaggactatcagcgacaggtgttgtttccgatctaaagacacttatttgattattttgattggaaatcaaaattctgcttgtctctgtccagccaaaatctatatttgattgatcgtgtgttactatttgactgggtaggaaaataagttttcccagttcctgagaataatcaatacggcagttttttttgtaggctctcatggttacttgaagatgagttctctctttccaagtgaaagtgtttaatgaaatcccgtttattaatctcggaataaaaagtcctgcaaatttctgtttagaatcaaaaaatgttggaaatgtacatgagaaggggtcagtggtattcgaattaatgttttttgtagaacctacggttatgcatgtgccatcgtacgtcattacaggttcttgatttctttccatcacaatgtgaggaatggtttggataaaatttacttggaaaaagatgtcgctaggaaaattatcaggatttaaaagataattgttttcataagatgctcttataacaaggattttttcatgcagcattatttgcttaaaataaacatttctgctggatataaattccacttttgcactgttaaaaatttgatctggtggagttgtttgtaaatctatccaaaattcacacgcgtacatgtaatgcgttggttcttcgtgttgtaattctgtccagcgtattctcttaatatgggctcttaatttagtttgagatccataaagaataaattgagcacggcactctccatgtggaatgtaattgtgctccatgcgctcaactatttggacaggaagtgataccaaattaatgctaggaagaaaaaaggcaaaaagattaataattaaaggaaattgttttaaatctaaatctacatcagatatattttgaacagccaaggttacattgccacaatctcttagatcgatatacgtaaagtaggctgctgtaaagcttccttcatctctgcacatacacacaaatgttgattgttgcgaaagtatgcttagccctgtccttaagcatcttatttcacgaggttttaaaaggattggtgctgtcaattttagttgtagaaaatatgaagaccagaccacataacaggattccattcttactttaaatcttttattgttgtaaaatacttaaatagttgatattacaattgcatacgtttgaagcggggtgttatgttcatagagttatgtctaatgttttctgtctcttgtatttgttcgtagggaaagtctgtcatgggatgaactgtcaaaattgggagagagtctgaaaaaaaatcgttccctaaaaagttaattcgaaatgaattgaaagcggcttcaacttttgatttgcaatctgcgtgtgctgtaggatggaaagaatgtggaaattgttctctactgataaagtagacatgaccaattatatcatgctccgttacaaatgtctcatttcggcagtacacgtaaattctaaaagtctcacgcggttgccaaatgaaaggaaatgagagtacattagatttctttggaatgaatagccctacagcagcaggattctcaaaggttcctcgtaaattgatttgtgtgatgtgattaggtgtcagtgtcattctttcagggaaataaatttccattgttttgaattcttcagaaatattgaaatacggcatgcaaatgttaagtgcaactgattgcatatttggtttagaaagtcttaagcgtaaagaacactcatccacacagaaacgtgaattcattactttaagataccgtagaaagacaaataacaccggtgatcgatattcaatcttgtacaccgaaagattgtgttctgatatcatttccacgttgcagattggcgttgcgctcgcgaaaaaaacattccaatatttgcagtatgttgtattgaaggtgaagatgcagtacatggtttccagtttttgatcattggagtttttcagtaaaggttgaaattcattcttttcccaagtaattttagttactgtggcatttacgatcagatcaccatttttcacagaatataaaattataggagttgttcctaaacccttttcaagataggcaaattgatgaaatctaagaggatccatattttctttaaagtaacaattatcttgtatcagcagggatgacgtaatgttaaaaattggcagggcaaaaatattgacaaagtttatcgattgtatcataggaaaaacattaattttgatcacttttttgttttttagaacgtgacccaccaaagttacgcattctgcattgttttcagttccatcggtaattagcaacagtacaggtctttcgtgcgaaagtatgcaggtaatctctgcgggagaaaaattgagttctggctgcaaatcattaaaatccacagtaaactgaattaattgcgataattcagagactggtgttgaattcatttttacaaagaaaactagaatatacaaatgattcttaattgttttcacacgttttatagaatctagcaagcttctaaggctttttaaaaccgcaatctactttttgaaggggcgtggttatttatatttgatccagattgcaatttttttttacgagcgctccaaccttttcttaagattaaatctggcaaatcagagataaaaattttgtctgctaaaaaatacagtgcgtcagattctggatcttctgagttaagctcaatttcagcagcaaaactatccgtatagttgggatcaaatttagttcgtaaaatatgcgttgggataaaataaatgctgcctattatgtcatttgtagtcactctctgcgatctatcactagtcacttttgtggtaaaacttgtagtgggagaccagaaagaagcaatagactgcactttggaatttgggtctggaacgtagagagcattagcattaaaattataaaaagtgcctttaaaatgaagttttttagtttcgccctcatcgaaaagcatcgtgtcttggaaaaaaacgtcaatttttcttttatcgctacagattttaaagtaatgcatatgcacagttagagaaatttcgtttgggattatttcgttgacaaaaccaagtttaagcatgcaatcgtttggaaccatatacgtgttatttttagttacctctgtataacatcgaagatagatttcgagtagaggaggagaaaagatcattttaagtacggaaactgttgggtctgaaatagaaaacactttgcacgttggaaaatctgaaccactccgaacatcgtgaaaccaaaaaggtaaattgtttatgttaacagagcagactgtacatagagttgttaatggatggccaggtgttctttcaatcgaacgttgataagtacttagtttccattcaatgttaaacatcgtgacggttatttcgtttactttatgtggggtttgcgtcactatgaccttttcgtttttgaatcttatcagactaggaaaaactcccatctgctcttgttctttaacatcatggtttgggatgatgacgatagagctgttaatttttaacaacggaaatccaaaaaacaagacttttgatggataaatgtgtctattcagattttttaaatgtagttttagttgttgttcttccattaaaggacgagcagaaaaaaaggagtcagaattccttgaatttatttcagcgctcaaaagtaaaactggttcagtttttgattggacatactcgtcaaataataatgtaacattatctttaccctggaattcttctttgtatggaatttcaatctgaacatattttaagatatcagaagttgcgagagacatggagctgaaataaaatctgttacaacagacactatttcaaagaactttttattcactctttaaatatacaagttgccagcctattgtcagcagaaacatcagccacaatgaaaaacgttttttcttgtgtaagggaattgatttggttaatcatggtgaaaaccgttttaattttctgtaattctgttttaatttcagtggccttgaaagaactaggttcttgagaaaaatttttttttgctaggagttcttgacatttaatcaataacatagactgatcttctaaagataatctttctatatatgtttgaactatatcaggagccatggtggcaatcatagaaaaagaaatgcatgctgttttcatggaaaacgtggacttacaatcattgataacatctggtaacttaattgttacatctctgtactgcaaagtgcgcagctcatctataattatttgaacttcttcatattttctatgtatggaaaggaggctgatgcaaagcattcgcacgtttatttccgttgcgacgtctgtagggatcagtaatggcagaatcagctcccagttaggtaagacaagtaattgttgcgaaggtttcagaaatggtggcagtaaactcaattgatctcccttttccagaggaaatggtccggtatttttgatttcatactggtgtccaatttttggacgtattaatattaattggtttccttctactttttgtaagattgttaacaccattgtttttaagatatcccttatttgaatataatcggtggttgtagataagaccgtgtaaagtcctaaatttgtgttgccaattaaatgacggtgcgacggtattgggatgacggcattagtgagtttgcataaagttccaatgtcagaaagagtaagcttttgatcaaaagtacagtagattgaatccatttctatagcagggactcaataatattttgtaacggaatacactcccctatagcgaaatttgcaaaatgcgtttcacttaactgtgtcattccgttcttagatcgactctctaatagagcttggttagaggagcaatggattggaaacgcaatttgtaaaaactgacaaggacgatgagtgacatcgtctgttccttcggaacaagaatactgaatatcagtgtcgctgtccaggcatgttttagtttttatggaataatcactgataagtttaaacataaacttatttgtcttaaatatttcagtgtctgtgaaaaagactgcgttaggactgtaactttttggattatatcctaattgatctctgtgatttatattatataagacatcagataaagatccttcttgagatgcccaaggatttgttgttgccacaaaagcatcgctatcaactcgagaatgatcatacaaagattttctagcttctgactcattatggggatcgacacccatcatacacgaagcccttcctctaggatttttaggtgttttatagaaattaatatcggaagtcactggagtaatgacaacctcgcagattgcttgttggccatgtaaaagtattgattgtgattgcttatttatcttaccgaaagaaaggatgtttaaagcatcggtttcggaaggattgggtttttcaatgccaacgtgatgcctaacccaactatttacagtagggttggtgtatgcgtgcattggaaagaccgaaaatagatcttgcactttacttcccatatcagtttttacccttttcaaatttgcgattgcagtgctggaactaaatcctaatcccatatcaagaaaacttatatgctgcgtaaggttatatgtggttgagatgtcttttacttctgtagataccgttgggtcatcaatcattatggatgttgcagatttggagctatacagtaagcaattaatgtcgaaacaatctgttcttactaaagtcgcagcgaaaccaggatgaattttttgtctgctttgaagaatgatagctattggagacaatttgcaatgcatagtagctaaagtcatgatacttagcaatgaatttgaacaacaagaagcatagacaaagaacggtgttctttgccaattatggaattcatgagataatgcttgtggtagaggaaaaccaccgtcatttctttgatagtggggaaatatgtttagataggtttgtacttcaatattcattaagccacaaataatagggtctgagaaaaaacgattaaaaggaattggcttgaaataccgtttcaacacattaattggtgatactaaacacagtccattatataaaacatgttgtagagatttgaagtttgaagaactaccatgtctttgagaaggatctaaagaagattcaatttccaaaatttttgtattctccgttaggtataatatagatttaaagagttgtttaccaatgcaagataaatctgtgagtgcatgtgagggaccaacagcttcagttatcaattcaatcaatacattgttcgtaatcggtaattcgcaaaagttgtcatcaggtaatataaagggttctgtgtagaagaaatctagaatgaaagatttcacatcaaaacctgcaccacacatcttgttatttgtcagtgctggtagaaagcagaaataaaaaattttgcttaaaacaattgtttcaaaagatggtctatctacgtctgtgaagatttctgttgaatccaataaattcattctattcaggtcagatacttcatagtttcttaatttcactgtattttgggtaaggggagtgttaccagctgtgattattgcatttgcttcattttttggaagactgtttagaaatggagggaatagacgattatcaaacaaagcgttcacaaatccaaccaatggttccccacacagttgctcattaaagtttgaaatagaaattgtccttttcactaattttaagattgaaattatatttttgtaatgtgtataagcaattcctggaattgactcatctccaagataggttgtaattaaccaaatcatttcaaaattattgcaaaacaataatatgtgctttatattataccaatacgtaatacattggctgacaacgtctttaagaatctgaaacgctgtcttattaccatggatgagaagttctatgatatatgctagttcgggataagctgtgttagttaaactttcaacgacgagtttcagggtgtagtcataatttaaattatttgtcttggcttgttcgatcatttgattggtcctagcttcatgaaaagatgaaggtgctaaaggcagaggtatattgcctaacaaaattcttggtgaacacaaaacatcagttgatctgtttttttgaatataggtgaaatcaaaaaatggatgtagctctgtctttaaagtaaaattttcagatttatagaaatcttctgtggtaagttcatttttaagcatattcgtcgtcttaggtatttcttttttcatttcatataagttgtataaatttgataaaaaggtgcttggaggttctctaacaaattcaacctgacacagttggttaaaagattcccccgtaggttttgcagcatttttaaaaattcgctctgagacactacaatcaaaaataattggatggcataatgatggcaatagatcactatagtctattctctgcaaaagcttatccttattatagaaatagatagatgtgggtagattgttttccattgtatcatttagtttaagcctgctatccatagtgctaaaaccactatccttcgaaatgtataagcccattgggaaaaaaaacgtcaattccaatttttgttccaaaggatcctcaatgttagtgtttttatacactttctttaaatgatctaagacaactgttttatcactcagttgaataatgtttgtctttagatcagcatgttgagtttggttttcaaagatttcagattttttgttttggtcttgtgtttcagtcgcaacgtttttggtataatttgaaaaatccgccataatagcctggtatgctattgcagtaacagcattttctttccccataacaaatgtgccataagaaacaggtacagacattgtcatttgtgaaatgtgttgcgatagggcgttggacaaaatctgaatcgtattaggagttccgagtaaaacgccgttaataggtgttccatcttttaagacatagctattggtgttatttaaaatgctttcagtggttgaatcaaccatttcacacagatatctgtatataaagcttacattagaagttctgttcaaaaaaaataaggaattgatgagtttgtttttaaagttttgaaacatattgcttcgctgtactttagaaagaatctgtttactgttgactttgttttctaacatggttttcaggataaactgtggcggtgccttcttaagaatagttttaatgaaagcatatattaaccctcgttgtaacgaatcagcagaattcttcagcgatcgtaacaccgtatgaatcgcattgatgttgagcatttgatctaaaattgtgtttttaaaggtgttttctaaatgcgctaaacaagcagcacttaattcaaacgatatattgataggatgcttttctgaatacttggtaaccagtacggttgtttctttaggcgcagttacgtcgtttcctgtagcgactctaggtaattgtatataaaacagaatttttcccagtgacattttgtctaggtcgttgaaacggataacatttgcagcaaccgctatggacgtatgaaaaaaatctatccattcagtccgattacagtaaatcccaagtaatgcttcgaaacttatgttataacgatcagagtcgtcaccgtaatacaatcttaagttttcaaaaagttgttcagcagtttgtgttctgatatcatcaaacacgtttggagaaacatctagttttgggaaaatttcagctgtgcgccaattttccatggttagtaataatgatagactcaatatctgaagaaactttaatagtaaagagctacaccgttaatcactgtgctaaaaatgttccagtgtttattaactcctatgatttaaccgcagaagtggccaaaaatgaagacgtgcgattagcgcgacaagttcaaatttcattagagaaaatagatgaagttatagaatcaattttttctgcgtctggtcctagcgttgaaaatgtaaaagatcaggcaaagtttgctttgtgtcgtttactgcttggtcctgtgagtattccgtgctactgcgaagaatgggatgtcaatttttatctgacaaaatgtagttataattgcgaaggcccggttctatatatctataaaaatgcttctcaatgctgtgaaagcacatatcgtttttctatcatgactaattatcattccactcacatctttagaggattattatcattacaagaatggaatagtcatctatcaaatatcttatgtacttgttcgaacgtaacaggtgataaatatactgcaacaatctttccaaacaatgcttcaatttacttggaatattatccgtattttctatgctatctatgcaagcatctgtctatcattgatattgagcaatgtactaatgaattgatagcttttcttggtccaaagacttctcaaaggattataattcactataaactgttattcgggtttcgatctaaaccaatgaatttcactgtttctttgttagaacaggtttttacccttgaaatccaaaaactctactattccgttagtaagcacaacagtacaacagcagattttttcaatgtcattaccgctaaatttgcagaggacaaatattttgttctacgaacatttaaattgtctgcgcaaatcactcctggtattcaaagtttttgttcattgaaattcaaactccagaccttatatctaaatttgaaaattatgaaaaacacaaaattatccatttctaatagtttttatcatggtaaaactttatatacactggatgaaaagcaacttgtttggagaaatttattgttaatttactatggttacaatttaaaagacaatgtaaaacaaacacaagaagagagtttgttgtcgatgcattacatacgaatattggaaagattgtctctaaaaagttttcgcgaaattaatcaacaatttagctttgaaattccgagttaccaagagaaaactttgcagtttattccaggtggaaatgatttcgcagaaatcacatcggtcacgcatggagaaacaactgtgaatgcatttaatacaaatagggtcatgaatgtgaaagctgctctttcaggagaaatacactgtgttttacatcgtattcctaaaagcatgacacatagttttgtgatgtataagcgcacttttaaagaaccctctttaacagtgagtaccttcatttcaaatgatgatttcaccacaagttcattgaacattaacattcgaggtccctactgtgattttttatatgcattgggtgtgtatagattacatgttaacatacaagatttttttttacctgcttttgtttgtaacagtaataattcgatggatttgcatgggctagaaaatcaaggaattgtgcgaaagcgtaaaaagaaggtttactggataactaattttccttgtatgatctccaattctgaaaaagttaatgttggttggtttaaagcgggaacaggcataatacccaaggtttctggaacagacttaaaaaatgttcttttgaaagaactcataagcatcggagaaattcccaatattacttttgatatggatttacatgctttgttaactcttttagagaaacgaaatatgcatcaggttccatttcttattaaacaattttttatgtttcttcgtttaggtcttttagtgggatatggacgtaaacaggaaagaaaggtccatcacattatgctattcttaatacaaaagggttttttcgatttttcgaagaattcagttgccaacagtaaaattaaacatgcatgcgctctagttggaagtcgacttgccaacaatgtgccaaaaattctgtctaagcagaaaaaaatgaaactggatcatttgggtcgaaacgcaaacgctttaaccgttttacgttttattgtagaaaatggttattataaaaggaagacaatttttcgcaaacttttgaagtatttagctactacatcttttaatgctcatgttcaaactgaaagtaatcgtttactcaacttgatgcacaatgacagcaaaacaaatttttccagtttggaaagactgtacactttacgttaacaatgagacagcaactgtgcatgaaatcttgaattccgatttaagtgaactgttacagttaaagacggaatttgtatctatgacagacctatgtgtttacattactggatgtataaatcagaatatttccagcatcacgatatattggcatgcttacagtgaagtaatttatgctttaactggaattatacactgtgaaaagatttctattgaatgtggaattaaatccacggacaataacattttgtatgaaaagcccaaactgtttttacttcgagaaaatttagcaccaactgaattaaggtggaaatctttaataaaaacaaagactataaaaagtgctctgtctccaaatcaaaatgagatttttcccaaaatagcacacaagccgtcaatccttttagagattgaagaagcaccccgatttaaggaaatggtgtcatgtatttggaagttagttgccgaagaggcgaccataacctcaaaaagcgagaatgatattgtcaaaacatgcaaaaagcttgctgaatcacaaagatatactttgacaaatggtactgtgttgcaaaattttatattagtccatgcctgcttatttaagcttggagctgttaatttttgggaggaaatgaatggaaaattacgtcaacggccagaactaatgtcaaaatcattcactggccatgaggaatgtttctataattgttattatttatgcactttgttaaattccatttatagttacaaaactttattgccagaaattgtagacaataccagatccattcatgtagtagtgaaagcatattattcagagcacatagatgtttcttacaaaattctttcgtactcaacaaacatgatgaacttattctctcagtatttaaattttacagatttattgccatatataaataagcacattaaaattgatgtttcagcatctaagcaagatatgattaaattcttaaatgcctgtttgggactttagatttctttaaatgaagtttgtttaccttcatggcacatataaatagccattataatagaaattaaaaggtcatctgaacaggtttgttttttggcattataggttacgtgttcatttatattaatttggtgaagattcttaatttgttcaatcacatactctattgggtcatacgttatttttattgtaaaggaaattagttcttgtgacgctttaatgtaacctgaattaaaattcgaaatgaaatattctacggctaatctcttttctctccccagtaaataaaatggttgtgcaatttggctctgatctaaagtatggaaaaatgttatgtgcttatatcttataaccgatatagtttgtttcaatatgcatgcaattttcaccgccgatgattgattggaattaccctcgataataattttgagctcagtaaaaaaagggtgtaattctaaaacagctagtatcatatgtgaggcacattcagcaattgaagcatcggagtttgatagtaaactttctagaaaatagtgctccattccatatattatatattgatcaccatatgttccgatcgctgctacccctgttccagaagcacgtcgattgattgtgtatgctggatcaatatatatgtagagctctttgcctaagaatggaattatctgtttgctaattgtgctatatcggaaaaggtcgaattcaatgagtccttgctctgttatcaaggtatcatttaccacattgcagagagaaccacccattatttcgtgtttgaaagcaccttctaaaaataggtcggcggtttttttgacgtcagcgttgatgctgataaatttcggtttatgtagtcggtaacatgcacaggttgttgcatttcctctgtcatttagtatgtgcacatgatcttcacaaacataagatactacagttaacatttcaaagggggaattgcttagttttgtcaagaaggaagtagagtgatttccggaatttgtggatgatataaaaataattttagtcgaagattgtggcagaaatccaagaattgtgctaaacgcgtcttttttgataaaatggctttcatcaacgatgagaagattaaagctctgaccacgtatactctgagaagaaaatgaacggagttttaaacgatataaagactgagtttttatgtaatactaaaacagatcttttaacgttgatacaaaaaatttgtctgaactgtgatttcattcttgaaccggtagaatcttttcctaaaaaaaccgagttggttgcggtgatgtatgatacgctcgcggtggaaatttttaacgatcttttaaaatataatgaacaaaaaaaagatggacttgcctaaatgtcagtcaatcacagttgcttgtgaaggagaatgttcgcaaatgtacaatttgcataatcctctgacatttgaaatgggtttgggaaacatctttatatgtgttcggtgttttaagatacatttttgcaatatgctagaagactgcaacctgataaatactcatgaaggatgcgtgtgttcaaaaaccgggcttttttataacggatggatgccagcctattcacatacctgtatggaacctactgaagagccaaatatggagaccgttaatgtagttgtagtgctgttatcatacgtttacagttttttaatacaaaataaagccaggtattcaaacattattcgcgacattataaaagatggaaagtttatagaacaagtagaaaatgctgttttttgtacatttaataaggtgtttaagaactccaccttgaataagttacctcttactactgtcagtcaactttttgttcagttaataattggaggccacgcggaaggcactatttacgataataatgtcattcgtgttagtagaagaaagagggaggataacatacttaaaaaaatgaggattgaatatggaaatgcacttgctctgtgaaacaatgtttacttgcagaaaaaataatattttaccggtacatttatgtattttactggatgatgttatacataaagagaaagtaaaagctatagaagggatcttttttcagtgtgtattttttaaagaaaagcttgtatatacggaatggacaaaaataaagtttacttatgtgttacatgatcttgtaatttctcaaatctttaagaatgcctgtattaaagaagtaatacatggggcattaattctttcagttcccataaatattgataacctacattttgatacagatattttaattctaaaaattatttacccacattttttgcacgatgatattgtcataaaattatcggaaattttgtctggagcacctcgcatgcaaaaaacagtggaaaaaaaacaagaggtggaaaaaccttttttccatattcctgcaaaacttggagatctcacaaaggaagaccctatttcgttcaaccatcatggtccgttagaacctccatcaactgttagaggattaaaacaatctgcgaacgttaggcatagtcatccaatatcaaggcctgaaaaagcgaacgtaacctttctaagtgattcgtggtacagccaaaatctaaagtgtgacttcatatctgacattcaacaaagacatgtgcttgtcattttttggtatgagttatcgaaagggatacaaatgcaaattaaaaatattcaaattcctcctgaaaatttgttttcatcaataacgaattatttagatagagtcaacacatatctagacgagattgctgaaagaacttttcgatgtattactactaacatggaaattcagaatagacatcttccacaaaaatttaatagtcattttcaaatagagtttaattgtactcacttaatttctggtatggaattggcgagggatttttggattttgtctttagatagaaatagttgtgttttaaaagctatggccagtcattttcttcataaaaaaaaagggagaagctcacttagttcgaatgaattttgggctgacttaattgattgcactacgggaaaaaccttatatggagagaaagtacggtggcaattaaattctgaaacgagcttatactccacattcagaaaaaatcaaaacatttcatgggaattacagcctaattgttatgcactatatatgtctgagaatttaaagctgtattgggtattacccggggggttctgcgtgtctggaacttttaaattaaaagagaacgatgaatttttcttcgattggcaatttgggatgtcttaggagttttttacaaaatgagtgtaattggttttcggtgtgtaaaaaaaagttgtaccacgaatatcgttgtgtggcaacatcttctcctgttttcgctgttgataaatttaaagattgcttgcactgtaatataattattttaaaaaagaatttggattttgtttttagcttggccataaacggaatacatgccggacagtttgcaacaaattccattaaactaaaaaaaattataataacaaacgatttggtgtactacatattagaattgggatctttaacggtaacggatttacatttcattccaaaatacaatagtgaacatgtgctgaatgtgcgacctattacgccaaatctaatttatgatacttgttcaattgttagttatgacgaagctaaacttttaactgttaaaggacctggagaaaataaattaattcctttgggttgtggttcttggtgtctcaacaacatgggacgttattatgtgtacacttttgtcctggtgtacgatttatatctggcttgctttgaaaaaaacactttgccatcattatctaaagtagtttttgatatgatttcctgcaataataaacattgtgttttttgtaaggatcatagtaaacacgtagaacaaactggcaaaaccgttggatgcactgataatcaagaaacatgtttttgttacaccccatgcaagaaaaaaatggctaagatttccaaccaagatctgtcttcattattatgtgatcaagagctcgatttacttgatctaatttaccctgaaaagcccactagtctttcaactgatataaatgcttacgtacatggacataagaatcaagaaccagtcgttttaaggaatacaaactggatattaattcgtcttgacccagcaattagcagattaatactcctttcctgtccagtctgtaaacgcatagtaagtaggtaagaaaaatttgttacttacgtgagtgttgtaacaactagcaaacagtgctgtactttttattgtttcgtgttcgatagtaatcacattatcttgacaggtgatattcttttgcgggaaaaaacgtctacatttaaattcaacatctttcataacaaagtgcgaaacgtgtttttgatgtgcaacataaccaatgctgattccttctaaattctttaataaaaaacaaataactggtatcatgaaccatgttttaccgtgtcttctgggaactagaaaaacactagctttctgtttaagtatgtttacgctgctttcgtttataaactctatgtcaaatttatattttaagtaatcaaggacatgattggccagtgtgggtaatttcgtaacagagatgaaaaaaattatgtgtataagaatgctcttttgaaatggctctagtttaattctttcctttttattggtgttctcaaaatcaccgcagatccatctttgaaaatcttgaataaatttttcgatctgtaaaaacatgggatttctgtaaaaacttgtttgtagctctagatgtttttgatattgtacttctgtgtttttctctatgattgcagtaaatttgagctttgacaaagcgcagttcaaggggtcgcatattgcaattttagattttacgtgccgttggcgatcacaaaagagatataaaggtttaacatgcctgcaatatgcatgtgtaaagccaagttctggagttaatataataaatcgtttttggcaaaatatcgcgctgtttggaaaagttgaagaaatctttacgtcctgttcatgtttccaaattatagactgatacgctttctgaattgcatctatatcgcatgatcgcaacatggacacagatattgctctagctgcaatttataaagaaacgactaaattaaatgaaaaggatgctaaaattttctcggaggcagtgcagaccgcactaactgtgtgtaaagcaaccgctcctaatacacgtctaaaactcgttgaaacaccaactaataacttcttactagtaacaaatgttgttccatcagaaacttcgaaagcaacgactgaagcaaatcttaatattgatgcagcgttggaaaaactggcgtcttcctttaatacagcggtacctgtaaaatcatccaaaaagtatttgttgcaaaatgtgagaaaaatgaccagtgagaacatcgctctaactggatcatatatcatctatacgaaaaaacacatcgaggtggcgtttctgttagataagtctgattttgttcaggatattttacgttatgctgaaacacccagtcttctaggacataccgatgtacgtgatttagaatgtttgttatggttagctttttgtggtcctatgagttattgtcaggctgataattgttttggactaaataaggcggggtataacgcccctttcccaatattgtttccaccatgcatgtatgaaagaaatatgaaccttagtgtattttttgggttattgcaaatttatgtgttctctttgtatagagattttagtgtcgaaaattcaaatttacagcaaggtattaaaaagcgtattaagttggttctgtcagatttacgggccaaagaaagaatttgtgaggaagagataggaaattttccattggcggctcaaatatgcctgttttgtgcattatatagacaaaataggctctgtatggaatatgccgcaaacaatctaagtatgagtgtgttcagtccaataatattaaaggactgtacatttatgcaaacaacagttaccataactcaaatcttgccaggttctaaggaagcaataatttttccagtttacgatataggcaaattactatcagctcttgttttttcagagaacggtgtacttttgaaactataatgtcactgcatgaattaataaaacaaactatgtccaaaaatttagaaaaaaaacattatgagttgttaaaattaaaacttggtgaagatcatcctcttagcgttcgacagcaaattcacgctctcaatcaaaatcttgtatcagaaaatctcgaacagtcccagataattacttctttgacaaaaatgttaaaggatcaaaagctgcagctgaaagcgcaaaggaaaaatgctgctcagctagaatgtgtagatttggatgacattttggatacggcagcggaagtgaaatccgtcaccgacaatataaaagaaactttactggccggattagaatcagactaaatatggagcagcttaagacaccccaaaatcaaaaaacacgtccaagaaatatgcttcctaaaaaaaaaggaaaagaacttaaaaaaaggccttgtaaagtaaaacgtaaattatttggttccgaaaacatcagacctaacaaaaaaatacctctggcttcagacgtggataacgaattggaaaaaaaacggggctcgatgatacgaaaacggtctgagacggacttatgtccagatccatctgtaacagacctcctatgtcatgaatctttgactgtatctccaaagtttgaacgagatggattgagtgcatgcacggaatttgagaattttatggatacaaggaaaatcgtgttaagtcgaaatgaaaagtctgtgacagatttaagtgcacattaccccgttttatgtaatcttggaatttttgagcgtattcattcaccctttttgttttcaatacacattgatactcagtcattttcagttgtctatgttccacataaggaaagttcctgttctcagttttgcgagccagaaaaaaacatggcacggattttaggaagcggatcatatggaatggtatatgatttgaacaatgttgcaattaaagcttctgatgacttagagagctgcatttcttcttatgtgtctggagtagttcgtgcaaaagccggagctcaattaacctcacgcgaatgcgtgtttaaaagtcttttgatatgtaattctgtctgcctgaaccataaaatctccctttccaaaacttatgatacagatttatataaatttacagactggaaattggaaaacgttgaaaattattactctattttttgcaaccttgcagaagctgttcgttttttaaacatggtgtgtaaaatcaaccattgtgatatttcactagcaaatattttgatacaccacaaggaaggtattattttggaggctgtgttagctgattacagtttagctgaagtacacccacagtataatggaaaatgtggaatactaagacaatttgatcataggatccagattgtgcctaaaagttataataaattgtgtgacatgtttaatccaggtttcagacccatgatagctcacaaaataattttggtcgaagtttatgcagaatttgatggtaagggcaatccagtgagacattgtaatctagatctttgtgcactagcgcaagtatttttattatgtgtcatcagaatgttggatgaacgcggatgccgtgaggcgcaaaaatattatgaaaatcgattgttcacgtactcaaatgaagcttgtactttgaatccaatcaaataccctttagaatataaagatgcttgttgcaaagttttagctgagcacttagttttatttggcattcttttttatcgtgaggtggtggatatgtttgaaaacttgtatgactttctgcacgcaagtggtgatttaagcgtaagagatttactcgaggaaacatatgtaaatgacagtagagatgttagaagacaaccaatcaggtataggcacgcccaattacaaagacacgaaattggtcaaatacttttaaatgatctgcaacaattgctttccattataactatttcagatttagagaaggatccatattctgtatttcgggtgtaacatggcaatagattacgcacaaatttcttgtaatttggcttctattatagaagaggactcggtctttttatttctaatagacaaattaaacaatctggacatttcaagaaggaaaatttcatttaattttatccgtctgtgttatacttattatatcttaataaagtttaattctcgcttcaaagataccttcttagccagatcgttcattgattatatgcatcaaaacatatcagattttatcgatgagaatgttgagctatctgatttatatagcaatatttatgtccgcttacaagatgcgagtccaaaagttgttaagaatctatttaaaatattagaacgagagacaagaggacagtcaacaaatccactctggcacgctatgcgaaaaaattgcatcacggcaactaaaatttatgacatctatatctctaaatctttttcgggtatacaggagcattcttatttaggagatgcggttttatatggaattaaacatgaacgcatcatagaacacctgttaaagacattctttgtgaaaaagccctggatatctaaaacacttggtttattattagatccttcatctggagtgtttggtgcatccatagattcttattatggaatctcttttaatgacaacaacctgatagaagtaggggataaagttgttatatttgaattgaaatttagatataaatatctgagagaaaaaaacgatctatttgtttccgagctgttacaaaatccgtcagaaattgctttagctaaattcatcttatcacatccaataccagctatagagtatagagaaaatggaaagatgccctcggcaagagaatatttaatcactaacaatcctctatacgattctggtaaaaaacgtcgtgcttgcttgactcccaaaaatttgacgttcgacattacacgactaattcccatgaacgaaaaaaatgtgtcaacggcaattatttttgatgtcgttaaagactgtatattaaacacattggttgcataccaaaaagctatttttactattgatgcttttataaatcctaggcatagatattattttcagagtattttacagcaatatgtaatgactcaattttatatacaggatcacgataatccagaaaatattgaaaaagagaatttaccctcggtttatattgtatctgccatatttcgaaaaagagaagacgacgaaaaaaactgtcgcttgctaattgaggacacagaatatttagaagaagaaatccctttaattttattgattactccaattactattgacgctgaatttacttcacgagtaatcaaagatatatgctgtatctgggaaaataaaattgcacaacagacaaatttaaaaatatgggctcaaagtgctgtaagacaatacatggcggcatcttcagcaaggccgaagacaccttagtagactataaaggaaaatatattaatcttgaaaaagaattttctgctttaagtgatactgaatctgaagaagagttgcaactagagaagccacttctaaataaacaagattctagcgtttcgttaacccagaagaaacttgaaaatcaatccaaataaacgtccattgattaaaaaccctttattcatttgcttcttctaatacatctaggtcttccactgttgtaggtaatttcttataattatgatgtttccgcataaaaaatctaattaatctgcatataataaaggaaagacaaactatggtgatcacagctagattgactatgaatttgacagtccattccgttttaaatagtgaatcatattttagtattgggtaggttaagcctaggataccaaacaaaattccaaaatgtaaaccaaattgaaccttaacatactgatgtaaaattaattcaatcaccaaagagtatacaaaagacataacaaaaaaggtgttgatagatgcgaaagccactgttgatgatttaatatagaaattgttacctaaacctagacaaatcgtaattgcaaacaccatactggaaaaacccaacattagttctatcatattgattatgatagttttatattttattgtgcctttgagttttgggtggatccgtttcaatacgaagaaagatctttcagaggattgatactgtgttatcatagtcaacgtgaaagctgtgaagcaaatgaaaaacaggcaatacgtaaaagctgcgagggtgactagtcgaaaagaaagacaggtgacaaagaactgatatgtatccatagttaaaacaaattggaaacacgataaactatcccccatccaagttatatcccttgtagattgattgatgttgggagttttttcggaagagaatacttttacgcaacaaactatatagtatactaagatgaagaaaaagcagatatccatgaaaacaacatagcagataagttggataggatttaggtagagttgtggcgttaggctgcggatgtcattccgtatagagaggttgatggctttcatatcattgatttcataatatgcgcatgggaatcccaaattgggaaagtgaacagccactaaatgcactgtgacgttgacatacgttaaacaagcacagattatacttaagacccaaattctcatattaatcacatctactctgctcaatgccattgtggggatctgtcaaatggaaactcagcttcaaaatgatcaattatttttggaatggtttggacaaaatttgttggattgccactttgcacaaaacgtttcagtgtatttgcaagatgcttcaatggttcattttaaaaccttttctgaacaaataaaaattataagagctccaatgggttctggcaaaacctctgcattgatagaattcttgaaaactgtttcatatattgattctgtccttgttatttcctgtcgtaaaacttttgctgcagaacttttaaatagattcaagaagaatgatttgaacgatttctatctgtacagcgaaattaaagagcgtcaaatcaacaagaacaaactgataattcaagtagaaagtttacatcgtgttaccaggaattatcatgttttaatactagatgaaataatgtctattataaaacagttctattcaaaaaccatgactaaagtcaaggaagtagatgctaagcttttaacgcttattagaaattcaacacagatcgtagctatggatgcaacagtcaatcgttatgtggtggattttttctctctctgtatgccgcattttaagtctgcattgatcataaatacgtttgtaagcgcgaatttttctaatagatctgcttatttttgtccaacttttatagatgggaatcttgcattttatggaattctaaaacaaaaattaggcttaggaaaaaacatttgcttattttgtagcacagttacatctgccgatttcatgtcagaattgttaaaaactgatttcccggataaaaaaattttgcttttaacttctaagcagggcaaatgtcattctgtcgagagttggataaactataatattgttatttatacatctattgtaacggtcgggctcagttttgactttctacatttttcagctatgtttgtttacattcatttggtaaaaggtggccctgatatggtttcggtttttcaatcaatgggtagagttagaaaggtcacagacaacgaaatttttatttatttgaatcctgcattaattcaggtgcctctttctgtatcccctatttcgattccacaatgctatgattggacactttttgaaaagtcaatcctacaatgcagctgtatggattttaataaaaaatgtctcagtgcacaaaactacttgtctaattccatgataaaacaattttttagaattaggcattatattgaaaaaactacgctattaaatcttcctgatagtctctatcttttatgtcttttattggatagtaattcaattaaagttcacatcgatggagacgtctttcctatagctaaagaaaaattctacgcatttacaaaaatgttggttcaaggttgccatttttttgaaaagaagaaaacagactttgtagaaaatactatgacactgaaagaattgttttctaatacaaatattactgttaacggagaattctatgaacttggaaatttccaagttcataaagattacattgttaatttaaataatttccagaatttatttttgaaaaatgatgttgacatttttgtaattgaagagattatgcttactttaaaatctgaaattaggaggtttgtttttataaatgctttgctacaaaaatatgttgccaccggtatcgatgtggaaaagattaaagcgttttttaaatcccgaatcaaaacatttactctacctgaaaactatatatgtagcaagttttatttattaagtgatatttcaggcgtacatgaatgtggtatgttgatggatgtagcttttttagcagaatctattagagcggatttaaatttacagtcctgtacagatacgcaaactgacatctcagaagatgctatcttactttgcgctgcaagaagatcatctgaaatccttaggattttacaaattgtttttacaacgcacgtgcaattatttgaaaaatacaacagttatacgttatatttgttcaataggttaaagggaatgcaattaaatacctggtcactttcgattgcaaaattcagtgtttcaataataaggatgtttttcaaatgtgcctttaatatgaatctggttaagagtaaacccagatatatcgttgggaagccatttagaagtctaacgaaaagggaaatagaaactttacttgacatgtggcacgtatcaagaaccaatctgaaaacctacaaagagttacgtaaggctctgacagaagcttcaaaaaaaagacaaagaaaaaaaatttataaattactaggtcacaatataagttcttatatcagtgaaactggttgtctcttccagcatgcagatgcggggatgtgtttgtcatctgggtgtctattgcgttcataacgattggaaaaataaacaatatagagtaccaatttatcaatgcctgttttttaatgctgagactcactccttgcatacttttttggttattggaaatgagatttctgaaaatctccttgataagatttccatttcaaaagaaaaaatctttatgtgggatttgaatgaacaaataatgagtataactcaaaagacagagtcaatctgtgaactgatgtttggcaacaaacaaataattcaaaaactatccagaacatttattttcttaacaattattttaaattctaatatgtatgaaataatagatgtctgcatagacagtaatgcggttttgtacatgccagacttaagaccaatgataataagatgtgttggaaactattcgaaaatatcttctgaactattgtcagattcagactgcacacaggcgacaaagaaaatgcgatttgattatcacgtcacaaacttttgtttctcattaaatgtcaatggtaaaaaagtactgttttctagtacagagtcttcagaaagtattttagaaaaattgcttgagtttttcacaatacaaacatataaattggcagaagaacaattcttaatggtgacacctaaaaacttttttaccgtcttatttgatgaggacatgtgtctacttttgctgcaaacagttgttagttttttgtatgacaatctatttcgaaataagttagttgtgaaacaagttcatgattacattggtccagatttgtggccgcaaggacatgagagggcagtttattttgtagggtttcctaatatgtggtttttatcgatttacgatttggacaacaagataccttgtattaaaaatatttgcaatagaattttactttactgtggcctgccagatagtctaggaccagatggttgccagagtgttccaagtacgcagtgtgtggatgaattcgaagaccttcccaatttgggagcattacaatatttgaaatataatagtttggttgttacaatggaaacagtagaaaattctgagaatgtgtattatttttttggagagcaggatctgtttattgtcaaattggtagacattattcaatctttgttggaactatatgttcctaaaagttttctcccagattttagcgatgcttatataaaaagtgaaatcttattgaaatttatatctcgacttcacaaaaaatctaacaacattttttgtaagatcgtaaaaaaaatcacagagtttttgagatgttttttaaacgcgtgtcgattaatggatcttaattggatgtttattagaaacatgcatattgtgtattttataggtccaaaaaaggatccttctgtagtacttcctctgttaaaaacgtctgtggaaagttgttggaaaaaaattctcaattcttcaagaactccagtagtgaacataaattacatccctggttacaatttcctacacagctcatgtagctttttgacaagcggagacatcaatagtgaagattctcattggactatcacagctagcaagtgtttatataattgtttaggggcaagtcagattacagtagattttaaaaatatttacacaaatttccagcagatggttagcgtttttctaagtcacagatacgaaaataaatattggatcgaatattttgagcccaacaactattttctagagacacacgaaggtttactagactgtaatagatatacagctgtctggacaacagaaaacaaactaataagacaatctgttggttatccattaacggataaaatagattttattcattacatccaggttgtgatagaaattttcaaaaagtggctcttaacaaaatatagtcaacaagagtatgcagaaactgttagattaggaagtaagatcatctctgatcatttacatttgtttaatgtaaactagttttttctatttctgtcatcttatattcctttgaaaaggcatcgcatatagcgctttttaaaaaatctattaaatatttagagtcgtcttgcaaacgtctcgtgtttagtgatagagtacatgtgtcgtcattgtcgtgagatttgaaaaaaagatttaacatgtgtatatttgctgtttttgactcataatagagctgaataatgggtggaactttatccagtacgtcttgctgtttgtcatcgtaaaaaatgtatcttaaaatactaatcaatttttgacaggtgcaggctagaagtttagagactggcagagttacactgatttttttaataatatctcgtaatttaagtagtgtctgcccttttattggtagattttctagagcatatacaataccacagagtaaaaactccgtgtcttcctttaaaatcaaataaatgattcttcgtttacattgagttttactcagccgaatctcttctagcgtatcttcggaatcaagaagaataatgccaatgaagcctagaaaccctaatgttttctcacatatgcttttataggatttgccatttacaattgtgccatcttccaaatgaaaccatacatcatcatttccaaccgaaatatcaattaaaggtaaatttttaatggaaacgtgttcggcgtgtttgtttagttcacagatattccggacgcttgatatattgaatatgtctagagtttcgaatccttttaagcttgctggcaacgtcatcttgcggatattgaaaatcttctgggtttgtggatcctaaatcaggtgtcaaagtcaaatcactttgtttctgagtatgtattaaatgcgaaagctcgttaatctgccgtatatagattaatcttaaataatgcttaattttacagtttgagtacacagctaacataatctcttttagagaaaggaacagaaactcttctgggagcagttcaaaatgtcttaattttagaacatgtttcatgaagggtataagaagcaattctagcgtgtaatttgaatatgagatgctgtcttcctgtccttgattgttgacattttttcgtagacggaatgtccttgtgtattcagtttcccataattgatcaatttttttgtctgcgtattcaatatctggaatatattgtgaaaaaaaactgtttgccacagctctggtgtcgtctattgatacactagtgaatgggagactttgaactttgttcagagctttagcgagagacaagctttcaatatctgaatctaaagtaaagtcatgtttagaagtttcggataaatttattaatgaatgcatgtctttaatcttattttcaaatagccgatttgcagttttcagtgtttcgatttcgtccagttgtgattgaatctgttcctccatgcattttatgatttgttttttgaagatatctctaatatcgcgatcattattgtcctgcccacgacgttgcaaatttcctttgctgattaataatttattctggtcaattatagacggcgtgatgtcttgtaaaaaaccctcaatactatctgttattccaattttagatttactatcggacaagtttaatagaaactttataagactttttttcgcatcgctggttttttcctctctttctataagttctagaatttttttgttatcaacactgttctttgatgtagttaaaactttaattggaaaagtattcagcaattgacacattttacggtgcctgtgtaggttttcgtgtttattcaattctgagtataagtgagctaggggtgttgtaaacagcaattgattatttatgaaatatggtgcactgtaaacaaagtactctagttccttgttattggagagacaggttatattgccgtctgacttgtttcgataaatgtttatgttggtgaaatcggcaatagatgttgaggagatctgtgttaaaatgtgcagtagaaagttctgtttgtttcgtatgatttcttgaatcaatctagaggaaatactttttgctaagggtgtcagcgtaaccttgttttttggtaatgtgacaattggtgttattccaatcgtacaaatccaatcaatgtatttattataaatgtcgttatcgagattttgaaggatgtagtttatcgtttgcaaaatgccttccaggattacctgtttgattgcataataccagatattaaaatattcttgaaatgacatgcctttgctgcggaacggaaatgctttcagatgacgttgccattcagcattgatctgctggatggatatactattcaagagagtgtgtgacagtgtgtaaaacatttgcttcttaaagacagccgagtctctaagaacactgtgtatagattgtcccttaaagaattcttttttaccgtgtagcatttctataaattttatagtcttaatagaaggaaataaaatgtcattgtcttcattattcaatggtaaatatgacacaaaattccttttaaacatgtcatctgctgctaaggtggagttgattgttgagaaagttgcagctttagctgatgcctgtttagagacgccgttaccaactgactggtttcgtaacattcttgatcctgaattagaatttaatagcaattttgaagaaattcattctataggtgatgaagaatttgctcaaccgttgccatttttaccttttagagtattattaataaccggtactgcgggtgcgggcaaaacaagcagcattcaaaccttagcagctaatagtgattgtcttataactgctaccacttccattgctgctcaaaatcttagtggtttattgaacagaaccaaatctgcgcaagtgaaaacaatttttaaaacatttggttttaatagttcacatgtatctatgaatgaaagaattagttgttcagtaacaactttagattcgattgcggatcagcaaaaacatgatttatctacatattggaacgtcatcgcagatatagcggaaagagctttgaatgcggcaaatgggaaaaccaaagtaatacctgatctatgtgaaagcagtgtgattgtgattgatgaagcaggagtgatcttaaggcacattttgcatacagttgtctttttttattggttttataacggtcttcataaaacacagctctataaaaatagagttattccttgtattgtatgtgttggatctcctacacaaagtggggctttaatttcatcgtttaatccgttaacacaaaataaagacgtaaagaaaggatttgatatcttatccgctttaatatgtgacgacattctatcaaattactgtaaaatatcagaaaattgggtgatttttgttaataataaacgatgcactgatgtggaattcggcgaatttttaaaacatatagaatttggtttgccattgaaacctgaattgattgagtatgttgataggtttgttagaccggcaacttatattagaaatcctacaaacgaaattggaatgacgcgtttatttttatcacattacgaagttaagtcatattttaaagttttacatgagcaggtcgaactgacaaataaagataatctttttacttttcctgtttatttcataattcagaataaagcatttgaagattacaaaaatgaaatttcaaattttactttagagattgaaccatggtttaaaactaatttacacagattaaatacttattcccaattcgctgatcaagatttgtctaagaccatacaaatcgaagaaattgtattagatgatggttcggtagaggaaactttgataacgtgtcatttgaaacatataaaacatagttctattggcgttacttccagaacaaaatcttcaactgttgggttttcagggacatatgaaaaatttgtggagcttctgcaaagtgatttatttattgaaaaaacagcatgcgaatatagcgtgcacgcctattccttcttgacaggtttaatgtatgggggtatgtattctttctgtttatccgaattcacgacttctgaagtaatgacagaaataagaaagatcaaattgcccaatattgattttctacaaacaatgacagctgaagtttctttgcaaaccttcgatgaatcagacgaatactatgatctacacattgcacctacagatgaagaaatgttagcttcggatccgtgcccagatcctttttttttaaagtacaagcaacttccattaacgaatgttctaacatttgaagaaatcagttacctttatacagtatttaaagagattttcatttctagatttgcaattctacaaaggcacagtaaagaaatgttcggcaagagtaatttaatcacatataataggaataatgtttcgagcaaaagatgtggggagatatgttcacatgttaaaagcttctacggcatgttaacatatgctgtgcctgctaataattatactttggaaggatatacttatgataatgtgattttcttagggacggataaaatgcttcctccgataatttacaaaagaggtttacccaaaattgttatcaaggatgaaatgggctttatttcgatcttagacaacaatgtatcaaaacttactgacactgtcaatggtaacagttttcatatctgtacaaccatagattacgccatagtttctaaagttgcaatgactgtgacaaaaagtcaaggcttatctatacaaagggttgccttagattttggaaatgatcctaaaaatttaaagttgagttctatatatgttggtatgtcaagagttgttgatccaaataatttaattatgaatctgaaccctttacggttgaactatgaaaatgataatattattgcttcacatattgtaaaggccttaaaaaataaagatactatgcttattttttaaatgccagagtttgtgttgattgacgtatttttttaaactaagttgaaattaagtttttcatgtatcgatgtgcttttttctggtatgtttttaatggttggcaattgtaaaaataaagacatgaatcaatgatttggtatacactattttattgcgaaaatgataaatactctgggtccggaagttgaggcttttagaaatctttcatcttctgaatctgcaaagaaaaaaatgcttagaatcttttgcacatctagataaagtaggtaaaaaataaatataaacaaaatttaccgtctgcgtagttatttgttccagttgaatgaggactgcagtattcttatgccaggtttttcaaagacgcagtctaaaagtaaagggaaaaacttttccggagtatacaaatgtactccggattgcgcaggcgtgtttattctacatttaaaattgatggcagttagcggtgtcaggtggtatgtatggtgtctattttaagtatgtcagaaatcaactaaagttccttttccacacactactgaaggttgtatgaatatcacaattcacaattttataacaatctagagttgctttttaaggtatggaaaaagcctatgaaatcatgcaaaatgctgataattgtacattcagaaagctaaaactacttattcttaatatctatgacttaaccttaaaaatctatgacaaaacctattgattattcttaacagctattattaaaattaaaagtgattaactattcttaaaaactatgattttaccccattccccacccccacccccacccttcttgattatatcccggaccccactaaatggattgtctttgtattatgttggtgtgttgcccactacacactgaaacatagtacaagggctaactcttaatggttacaagtatgcagctcaaaatcgtaatggttctgatctttcttgtacatgttcaagttttcggcggttaagatgctttagagatagttcaagattttagattcaaaacatcacttatctccacagatcatttccaagcaattgtacagaaagatagaatgtcaatgagaacagccgttctcattgtcttcacaaagtgaggttcagatcatgacatagtagccgtaaatggctactgtggtttacattataaatgagaacagccgttcccatagttttaaaatgaggtttaaaacatacagtagccattacatggttactgtggtccaaaacgcggtatccgaatcgcaatccacaatacacagtcccgttgttcaaaaagttatgcagttggcggtcttaatcaggtatgagatggtatggcaatacacgttgtaaaaattctgagatttgaaacaatgatgtcactgttgtaggatatcctgtagtttttgatggttttttggttgatgacttacacaagatcaaaagttactggtaatccttagtgttagatcttacatgatatgacaagagaaaaaaagctatatatgggaagggataacccatatcaaacaagaaaagttaaagagaagaaactatgagatgggagaacctataacaaatacacttttaagattggggtgggtgaacagggcataactgtagcaataaaaccagtgaccgacagttacattccttcataaaaactaacgtgatagcaaaaaaaatatacataaataaagaagatggcttttcaagtgataatggcagtctagatacacttatattcgtgagaggtgtgtcagtccatatacaacttttcctattacctcgtctaaaaaaggcaacctaaaactggctgttttacctgggatgatttaaatatagaataaacattcacctaccttgttttcttctctgaagagtagtagtgttgactgcattgtctccgtgtatcttgatccaatagagctttatctaataaatacaaaaaaggaaaaatccgtatattccataacttgttaagtacaatttccataaaaattgaaaaaatatatcgtttagatgttatacaaaagtttatcgttttaactaatcattgtctattttcagacatcgatacagagtttgatatttacgagtttttcgaaagattaaatttcaatctcacctctttcgctgtcttaacagttcatgtagatcgcgggctttataaacaaatgctttccagttttccacgccctgggggatatgacgcaatttccttcatccgtgaacttgtcgtgtttgcggttaaactcgcggaagtaaaccgttattttttctcgaacggtaaaatacaaaaacggtttatgcgaaacaatttcaggcaaatatcattgcgactttttaaaaacgatttaagttatgagggtttttgttggctacattccggaaatcaattttcatgtcagaaagcataaaagggagatgcttttgtgtcaggaagcaactttatcagtcaagaactgtgaagtacattccttgagaaatcacttagactcgtagtaagaagtgagtttttcagtgagtggaagcaggtaagtataaaatttccctattctatttcaacctgtactcgactctgaatacgttatttcttttattgacagaatgattgcggaggatagagaatatggaacgtttgaatctgtaacccaggcttatcagcagatcattagtcatactttacagctgagacgatatgaatttgaaactgggtgcatgattatgttttctgctaattctggaaaatgtgagatgctctctaatggttggatttcaatgatttcatggacttcagaaaccgatacggccggctcattgacattggatatttgtactgagggagggcagtgcaaaacttacagtgccagaggtcatatattatgttctaaaaacatcacttcaatttctcagaaaaacgagggaaaggaaaaagttttgacgatttgtcatgacaatggaaaattgcatttaacttatatcacagttctaaaaagcggccttgattgtgatatcaaagaccaaaaactggagaaactgtttgaaaaagaacatgcagaacgaaaaaagcaagatgatgattataaaaaaaaagctcttaaacaaaaagataaacgccgttctgagcaaaaaattttggaagactgtgataaaaaagatgaaaaaaaaagaatggatgacaccgaaaaaagaaaactacaagaggaccgtcgaaacgaaaaacaagacctaaaaaaaagagtagatgacaccgaaaaaagaaaattagaagatgaccgtcgaaacgaaaaacaagacctcgaaggttagttgccttttttctaaatcactagtcctaaatatgacttgttgaatttttgtagtgtctaaggtttttacataaacatgttttcttagatgcatccaaagaaaaaaggatgaaagtgcatcacgaaaaacgtcatgcggaagaacaagcaaacgaagaggttgcttcttcgagtcagttatcaagtagaataccagagggtgcgttatcgcccactatttctattgatcttcaggaatatcaagaatttgaggattttgacaagcgcatttgtgggcaggtgggtggagttttgggtttatgatgcatttttattgcagttttttatgtggttaaagatgtttctttcttttaggggaagaatcaagacgctgtatgcaagaaagtccaaagtgatgaaagtttttgtataaataaaccgttagagcagtttagagagaaactaataaaaattactcatgaagctgtacaacagtcactgttacaatcgcggggaaaaaatgaggataataaaaaagatgttacccaaaatgtaaaattcgctgatgaaaatatgaatttcgcagggggttctaaatgtacttctaaaactaagcatattgaagatcaacaaatacagtttggggcacaaaatagatttgttcctatatgtgaaataaaaccatttattgatgtcaaccttttaaaatcaaatgtaagaggtagaaggagtactcgtggaagaagaaactcaaactccgctagattttcggcctctacttttgaacaaccaattgaaacttctgagatgctgacggtttcgactcgatccagaggacgttccaggggaaggccaagaggcagaggcagatccagaaacatgtcaatgagacaaactccaagagaagttgaagacatgttaccgattgttttggacagtgacagtgacacggagactttaaggcgtaatgaagatttattggcgtcttccatattacagactttataaatcgtttgttatgttccaatcaattggacatttgttgtggatttgtaaatatttatttgcttttaaaaaatgaccacaaccgataaaaggtgtttttgatccttttgttctcggagatggatgtgcacattccaaaatcaagtgtttctttgaatctattaaagacacgagtttgcgagcctgtgatccccacaacataaaaactaagttttgcattttttctgatagttggttaataattcggttgctcaaaacttgccatccaatcgcttcatgggacattggtactccccttataactgtgaaaacagtgttgagtaacaaaacgccttgggcacaccaagattttaaagatccgtgggctggagctttaaaattctctattgttctttcaagttctgcaaaaatggtttttaaagaattcggaggggaacatcctctcacagtgctgaaagctaatccgtgacctctaccatcgggataaggatcttggcccactattatcaccttaatctcttcaggcgaacataaataactccagctgtgtacattctgaggatcggggtagataattaatctttctctgtcacgctgaaccaatttgtatacattttgtaattgtacaatgtcagaatctgataagtttaaaaacttaagccacttcacattgatttgaaacgtttcatgttgttcttcaagagacatttttattgagttgtcatctgaaatgttttccagcatccactgtagtaatgccattattgaatgggagaagcagtgttcatgggctttttattaatgttgcctgaacacgtgacacataagttgagcgatctataaagcatgcgtcagtaagttctaatgagcaaattcgaaaactcgcttcggaatggaagcacttcattatatttttccatttcttgaattaacgggaaactaaagttgtaatacctagaaaaatatctcaaacaatttaacaaagcatcaaaaacattaattccatggtgatcaattctcacaattctctgtgtgcgagtctcttcattttcaaggtaaatcaaaattgacatgttaaaatttatcatatttgatggtatattgaattcaaatccgattatattttctacaaagatgttgcccgtgaatttgagtttttcataagagtatgatttacacacattatctctacaggttaaaagtgtgttatctgaaagacatctttcaaagttatttaaaaagccaagccagttgtgccctgattctgaatctttaattaaggaaagtaaggtgtgtagttgattaggattattatacagtaggtaaaatgtttctaaaaaatcttcatcaattaaaacttgatctctccttgagatatagggagtatgatataataagcgagaaattatatccgattttggtataggtgcctgatcaataggttccagaagcgacagagtttttgattgggtacaatttagaatgtttttgatacattcttgttctaaattagaataataagagttattaaataaagcatatatttggtttagaatggagataagaaatataaaaaagatgttagttttcatgttccataaagttgtatacaaaacaccaggaacttaaatatggaagacacatttaaatggaatctaataatttacataccgtttttgaagtgagctttctaattatttcgtgattatagaaattatcattctgttcttaaatactctgaaacagaaaatctggaattcttaacagtaggttttccttacctgtattagtagaagttgtatttttagaagtcgaatctgagtcaagatctatagaaaatataaactttatatcattccaaaagttaagcaataaatatataacgtaattcgagtcaatcagagtacataagttttaaaatatactatgtctttaatagtttaccataatcgtcccagtagatgtatctattgaaagtattatagatgattaaatgctctttaagtaataaaggttgtgttaactttgagacatttagtaaaatgtcagcagggtaacgaattgaaaattggacacagagatgagcagcacaaaatagatctttttcagttggggcatttatgtacagagagtagacaccactatttttcctgtgtttgctgttgacattcacaggcatcatagcttcttttctagtcagttcagtatgtggtactgttcctctgagaaatctgttaattgctatggcagttttctgttcatggaaaaaggtctcagaaacggtttgttcgcctttgttaacaatcagattagctatttccatcaatttttcgtgaagtgagtttacaagtaatccgttacgtgaataaacttgaatttgaactacagtcgaattataaaatcgaagtaatttataaacttccgataagaaatttttcggcgaacataaaccgcatggatgcataaaatcacaattaaaatctgtataattttttatttcaggagagtggataggtttggaatcgttaaaattgctgtgaacaatacccttagattttgttgcaaagtttgtcgttgagagattttcttttacagccttaaatatttttctcaatttagaatgtttatagatggcattcgtatatttgtccgccttaagtaacatttctgattttgaaatgtttatttcagaatttattttttcaggaattgtacattttatggctttttcattaaacggtaacgtttttgaaaaacagttacatgtatatcgagcattggctttagtacacatgcagcttttagaagtgagtttacctttggccttacaaacagttttacgttttttgcccctcatattcaagtactgaagctttcaaaattttcaatgttgatgagttcctagtttacacagaagggttgaagctattataacgaaaagcaggacactggagattattaaaattatccacgccaaatcgttgttaattaactctgactgtttaagagaatcatcacttaatattgtatcattataggggttttcaaatggttgaataatcgaggtaacattctcgtctatctctccgccgtaagacagacaagtgatcggtttgccaaagaacgtattgctgccttgtcttttaaaaagaaagctgagtgtcgttgtctgcgagccgttgtaattttcacgcactgttggactgtcctgtctatatatcttatctaaaaataaaatggctactaatggctttggatacgacgtcacagaacatgttacatccaaaaaattttgcagatggcgatagtacaaagcaattattggcttcattgaaagatgcacacaactcatagtagacaatcgagtcttggcgaagaatgcacatgttaagcaaccagcatcgttaattgttcgagatttaaatttcagcaatgctgtgatattgttagcattgaagtaaataatgctttctttgtcacgatgtttaaattcatgaactattttttcactcatgtttttcaggtttttggtatttatggtatgatttaatatcagttcgtaatgtttaaaccatattacagagctgagatttttagttgtatcaacagtacactgaaatacaattgtgtttcctagttctactctatgatgcattattggatataatgcatatatgattacagaaaatccaatcatctttatgaaaattgcacctaagaaaggcattgtgtgaaattgtctgattttggatttttctgcatctatattatctggacacaccctaaaaaaccactattttttctcttttactttgatttttgtggttttttttttaaatgtggacccacccattcaaaaataaggcgtttggggtaaagcaaatgtaatctttattttttttttttaaaatttacaaagtgctgtgtattttgaaagaaaatctctacttacaggattatagatggaaatcggattatccccatcggtgatagagcttaatcgcagaacaatttcttttggtctcttttttgcataattgttacagattttagctgccatgaaaaaatctattggtgttgcagcgtatattataattgttttgagatctgaatgtcttgtatacagagtatgtgcactattactaatgttctcccacaattcatgcggtccttttttttgtaattcgatgaaattctttatggaatctttgtcataatatcgcgggggggcgtggttcattttaaagggttcagacatggtgatattaggtcttaccattagctctttttgcatggcttttatgtcttcggcaacagtttttgacctggtaaaatatattataagcgcaccggatttagagcttccattgcagcacaaagcataaaccgattctttcaatttggcttccggaaacggtttttttggaatttgtttatattcaaaagcgcggattgtttttcgaaacagtttttcaaaatctttagtgggaacacgaccacgttgtactttaaatttagctgattgcttttgctcttgtaattttacatactccctgtaggataaatcattatcagatagttctgagtcagatttttgggtaccagatatccgctttttgtagaaaagctgcatgcttgagtccgaatcatcagaaaaacgtttcctcgcatttctgcgtttatttttaaaaaatttattagtacttttcttttgttcatactcattcggaatacttttggccccatgagtaaaatctatatctacacgcttgcttttttgtgtagatccagaagaccacgaatgattagaacagcttctttccgatctttttttgcaatctgattcagaagacctgcttctacttcttagagtttctgaattcttatttttacaggattgataagtgctttcagaaatactgtgttctgaatttgatctagatatagatatcaaatgtttgcattgtgtttccgactgagaatcttgtttattgttagaacacactttacatgttctggatttagatgcagatctagatctcgatgtatcagagctgcttctagatctgtgtttttggcgatgtcttgttttagtactttctgaacatgattctgactcagtgtttctgtgttcgtgccgtctctttttagaagaggaaaaggattgggattgtaaatctgaattggtatccgattctgactctgtgctcggtggtctctttttccttatgtgagggcgaaatcttggattatacaaatgttcattgttttgatctaattgaagtctagattcaacatgtttatacaaatttagctcttttccacacctgaattcaaattctgacatatcaactttgctaacaaaatcacactgtctattgccattagaattaggagattctgtatatgaaggttttaactctgtagaggaacaactatttctacttaatacagaatttttagaagatgctgagctagatgacttacaactgcatttactgcttgaactgctgcttgaactcgatgtatccgtatcagagtcactggatgaacttcgtgtagattttggactcatagatctatcacttataggaaacttttttgtttcagaggagttctgtgtgcattgtaattcattatcaaagaattcaaatagcccattctctgtgtctgatttagctaaaaattcttgttcaggacttacaaaattttgtgctatttcatctgtggtttgagaaatgatctgttccatgtgttgattttctatgctgtgtacatgttcaacttccgactgtgaataatcatttactggtgatttatattgtccttcctcagtactacttgaatcagatcgtgtcctttgtgtaagattgtcgttacacatggaatctgttgtatttgatttttcagattctacagggggattatcgatagaaggtatattacatggtgctgtgactttcccctcaaaatcgttttccttagcatctattttggaattaacagtagtttttgcttgtctaggtctacctacacgatatgaattttttcctgtacattttgtatcagagaaaacagtactagaattacaatttaaggcagtacttactgtacagcgtgaagattgcttaatgaattctatatcagaagcagaaatgtctttgtcatttttttctaggagtcttttaaaattaatcaacttagttggagctcgttgatttgattcctgtacgtctggtttaggagttaatggcagtggagaaagcattggttctagttttgataattttctgagattttctatagcttcatctggtgatttgtcctttttctttaagtttgaagaacctttgtccaagttgggacaatgcttagaatctgtagtcgatgtgatttgtttttcttttgatgtactaggtcttgttctagctttcataaaagtcttttcctgtgaagacttgttatatttacatttgtctacatctgaagtcgaagatagactgtctttagccaggggaactatatcagcattataaattcttttaattagatccatcttatgagaacttggaatatatgacaagcttacaacatcctcattttgtggtgttttgtctttgtctgtctttttcctggcaggtttttccaaattgttcacgtttgagattaatttggtttccttgtgatttgtctgaattggtgtattttgactgtattcacttttctttgataatgtaagacctgatgaaatacattctttttgaaggttttgactatctgtgatcatagagctgcttggaatttgtgaaaaagccatgctgtaatctctgctttgaaagccatagttaggacaaagttgttgataattgtctctgtaaggattatgtctaaaatctgaattgtatgagtcatatgactgatctcgttgcatatattccggaaaggtaaattcatttctgttggaaaagtcatgaaatttagcatagccacgtccacgtctgttgtaaggtctgtgaaaatgtttaccataatgattttggtattttgagttagggttacaataatttctactgtcatattttcctctgttgttgcgacccctgtaatgatgttgtcgataggttgtatcgaacgaattgtgacaaagttctctatttttatagtccaaattgttaaaaatatcaactgaagattggggttgatatggtaaagagataaaattttctccacttgcttgaggataattataatacaatgattgcagtccttgatgtggcaattctgatgcaaatcgaaattgtccagtttcagttgtatttggagaagattcagaagtaaaagtacttcttgatttaagaggaatagcacgtcgcggatcttgaagagtttttgatgtgactatttcttggttgttaaaatttgaataagttatttcattttctggttttgtatgatcgtgaatttcattatataaacccgaaagagtcatggcttcacgaaccacgtcagctgtagtgctcatgggtgcatgcaatggtcttttttctgaaaatgaaaaataaaaattgtttattttaaaatgttattaaattagcgataatactaagatgatatatacctttaaatagagtggaaatgtacttttaattgtctagaaaatataacgcaatatgttagttaaaaatgtaacttgttagattgatatttcatgggccctgaaacctgcatatgagctaatgtgtgtacaaatttgtgacaataaatattaaagtggaaacattccaaatgtagcaatttacatgtaaacggatatgtaaatgtaataaagatgtgtatggttatgtcaaaagagctaatttgcaaacatgcagttattaattgtaatggatgtacaaatgttgatacatgtttgtgtctgttgctgtgtatatgagtttatgttaaatgtttatgtaaatattatatgttggtacatatcaatgtatttatgttgataagcagatgttagtatgtattagtatcaatggattgtagtatgctactgcatgctattaaacaagtagagtgtttacttgtattagattatatttacatgacattgtcatgtaaatatatagttgcatacatttttcatgtaacaacacatatgtgttcatgtacatattacataatatatgctagtaaatgattacatgcactagtaaatatttgcacatgctaatgtgttcatgtgggtatatgtacatattacataatatatgctagtaaatgattacatgcactagcatatatttgcacatactaatgtgttcatgtgggtatatgtacatattacataatatatgctagtaaatgattacatgcactagcatatatttgcacatactagcatatattatgtaatatgtacatattacataatatatgctagtaaatgattacatgcactagtaaatatttgcacatgctaatacataacagtacatgttaataacttttgatctatgccgctacatgttagtacatgctatactgataatgcgtggaagtttattatttggatttctgtaaggtcatgtgtattctatgaatgagtatataaatgggtatgttaatatatgttagtatggttgcaagtaaagatatgttaatgtgtattagtaagtacgtaatgtatgtgaatgtattcaattttcaaagaaatgatatagaaatttctaaacatgttattgtggaaaatgtagatcttgtgatctattataataatataaacataaattaaatttttaagttatagctaccaatctttgcctatttttcttggggggcatactttttatatgattttatatgtacggaaatatatgtacgtagaataaagaataaaatacttgaaatcaaaccctgttataagtaaatttacttagtatcatatatgtataaattttgataatttatgaagatggcataaatgttgaaaatattcatgtgtttgttataagaatttcaatgttactaaaataaaaccaatcactaattatcttttatatgcaaaaatgtgtctttgtatatattcaaattaaaatttaaaacttatgttttaatcatgtgaaatacagatgtatgaatatgtagcatggaaacttcaaaaatataaatcatatagacctattgctttaactatatttaagatttacatatttaaatattacataataaaaattttaatatttaaataaaaatatgtattataaatatgttatttactagtacagctttataaattaaagaacatatgtatttaaagtttaaaaactaatgaaatgtgcttctatgagttaattgtaaatgtcaattttgtgattttaatatttttctaaataatgagattcaatgttgttaattagatgtgtgcagtttgagaacatgtttatatttacaaaaatttgtatatatttaaaaatatgttaatcagcatagccttatttataatgattaattttaaattctatgtaattaaatcttatggacaaaataaatttcaaaccatttattttgaaaaacataaatgcagtttagaactgatacaattttttttttcaaaaggggtacatacttaaaagattttttacagtggttataaaagtattagaaaaggaattaagatatatatgaaaaaatttccatcctgcttatggaactataatatatcaaagcaatttatttatgaaaattccaagtctatgaaagtaaagatacccattcaagtgaaaggctattatagttaggagggctagcaatataagaaaacttatattcaatgtatttttttttaagctatgaaagtaaagatacctattcaagtgaaaggctattatagttaggagggctagcaatataagaaaacttatattcaatgtattttttaagctatgagataaatttgataggtctaaaacattttatttataagaaaaaaatgaaaaattttatttcatagatacaataacacagatgaaagttacatttataatgtatctatccaaattcttataatgtgtaaacagtaagttaaactaatatgtaaaatatttaagtaaaaaaagtataaaaaacttaaggtttatttaaaagtccatattttataaaagttaatgaaaaagaaactgaatagaaatagattgataagtccatatgcaaaaactacaatttcaacaaaaggaaaagtgatgtttaatagatttgagcattttccaaaaatggatcatatccctgtggataaccttcaagaaagtcaacataagtttgatcagaatctgtgttttctttcccataattttgagtgtcaacactctgttctaaaataaatgagttcatctcacttacatttttatttgcatatctcttttttaattcttcataatgtctattaataccatttttaatcatttctgtgatttccataaaattatccatgataatatttgttaccatggttttagtctctgaaatgctgtcaacctcaataaaattttcttggagttttggaaatatatatgagacattttcccgcctatattcttcatcattacttcttattggaataaaatgattattaaaacaataacttgcttgtttggtcagttctttattttcatcttttttcatgcctgtgtctggaatgttaactttatgagtcttacgtaaaaaccacaggcagttttttttaggaacaattttaactctgacacctcttgtcaccccccgtatggatctgataggaattgtgaaaacaacactagggaatccattgttttcacagttatcagaattgttaattagttttgatctgtaaggaatagaatctgtagacatctctgtattaaaattactcatgttttcattgtctgtatcagtgcaagaatttaactccatattattgcagccctctttaacaattagtttttttttttttgctttgctagttttcaacttgctttcactttttctctttaattgtttttttttaacagcactgaaatcatgtgctgtagtctgtgagtcactgaaggatgttagactgacactactgaatgtagaatttgtatcagtgctggagctctcactttcatatatggttgatttatctgtatcataaccatatgtttccatctcagaaatcaccagatttgtattatctgtatctctactgttattattggaattctgctccaataaaatcaatccttcagcggccactttttccacatcactttctgtgtcaacatcagctgttgatctttctacagctctattagttgaaatatcctttttcttatctctgatgtaaaaggtttcattaggaaatttatctggaataattaaatcttttccatctttatatttgttttcatttctgttaaggttatgaaaatttacattggaggttttattgccctgactaacactctgtttatttttaatcatttcttcttgccctgataaagacttatctgttttaattttaacatctgttttgtcttcagacagattgtgacctttgttctgattatctaatgcatgatttgtcatggtaaaaagttcaaagtactgttctttatcttgggtgtccttattaaatattgacctttccatgagtattccagctgggctatttgtttttttatctgttctggaaaaggtagaaggaaattcatttgaaaatgtcaaagagttattgacgcaaatttcctcagttactgacctttccatgagtattccagcttggttatctgtttttttatctctcctggaaaaggttgtatgaggaaattcatttgaaaagttcaaagagttcttatcttgataagtttcctcatttcttttaaggttatacaaactcatgttaaaggtttcattgttcttactgactttctgtttgtttttaatagtctttctctgtcctgttagaatttgatctgctttagtatccctgcagcttttcatagtagcctctttgaaaaaatcctgtgtggctgctgcttcggaaagccccgtctcattttttatagcattcacttcagaatttttctcaactgagattataggattatcagataagaatctgcaaatagtattcctggaaaaatcctgtgtgtctgttccttcagaaacatttacctcactttcttcagtactcattccaggatttgtttcagctggatacatgagacagtcaggtgagtcttttgaaacaacctttttggcaagattctgtgtatctatctcttcaaagaaatctaatttatattctctggtacaaacttcaggattttttccagttgtgtttttagagtgtgattcatctgatgcttgtgaaacagccagagttgttttaatggtttggcatatgtctgaaaaatttgattgaacattgtactgttcagactttgaaacacactgtgtaggactgacattctgatgtacactttggtaggattgttcagatgtttcagaacattcctcagaatactttccataatcattaaaatcttcaatttctggtggagtcgagtcagaattatataagtgtgactcaagcaaagtggaagagtgatgtccatttcctgtgacatatccatttctaatggatattgaatttaacactgtaacttctcctgtgacatcatatagcttttctatttgatcacaagcatcattaatcatatgcataagtgtgatcttaaattcttttctatttgccctgaattttttgcatgaaaattctttagagcatattacaatacactgcagtacagcagctcctaggttttttgctgcctctattaaatttatacaattgaaatgtattttaaggaatgtttcgtcacacattgacatgaacatctgattcatctgtttgattgcaaagtctttcatagtttgagctattctgctgtttttttcaattatttcaaatttacattccaacaaatcttttttaatcttatttgtttttatgtagaatgcctgattggaaatgtttatatctgttatgtctctgttttttcccatcattaataacattgttgcacatctgttaagtttctcattactgcttataaagttgcccatacttatgatcttttttatacatttgataaattctctatccatattatttctcaaatctgataaatattctctacaatctgcaatcacttttttaacaatttcatcaaatttatcacaggcatatacagtgtatcttgattcacaccaaagaaaaaattctaattgttctccagataagatatcttcataaaaagatataaatccagaggaagcaccactaattaaattaacatttagcatctgagataattgttctaaagcaagatctgtaagcatgtgtctgtcattcgttaaaattccagcgtggttaattaaacaatcttcaatgtctgctttttcctgatccatggcagcattcacggatttaagaataccttggatgcaggcactaatggactgagctagaatttaaagaaaaaagtctaaatatgaaatctgtacacatatatcatattttatatgtaagaaaatgaaaaaaaaatacctgctgccagtttaatatccgaggaagctccttcttcaacatttgtggaataggaagcatttgccgttgcaatatcattagatgatattgagtcaaggaaatcaaaagaatccaattcttggaagagagtattatcaaaggaagggttgcattttaaactgtcttgcaatatgtctctgatggtctcttccacggtggtatctgggtgatatctgtaataaaatttataaattttattacagagaaattaaatctgtcttttttgtattaaaatatttaggtttacctactcaatatgtctttcgtcattcgatgccatggtttcagatggttgtccaacaatcaacataggtgaagtagctccacttctttccatagttttatctgtatgtttagccacacctacaataacaaaccaatcagaaatattaaccccattccaaactcaatataaggccagcctaaaaatactttcaagcagagttttaaaactctgcttgaaaaaaatgtatactctggaatatgaaaaacgtgtatcaaggccaaaacttacttattggatcattttggcaatattatttgtttttttaataataactggatctgtattaattgtaattgaaactctgtcaattcaaagaacgactttgaatgctcaaaatgataaaacaagtactgttgttccagaattaacatctaattctccaggtttgttcagctataaaatgtcattgtttaaaaaaaaagtttgtaactctgttaatatgaatattttttcttgtagatcaaacaactgtgacaaatttttctgcaagttctaaaccaactcttagcagtaaacaacccggatggatacaggcactaactacagcttttggaattttaacactgttttcagttatgatgattattataacttgtaatttttggctaactgagaaaaatgacaaaactgcaaatccaacagaatactactcagaagacatattagattatacaaatccaagttttacagaaattgatgaagacagctcaaaagtataacattgcttcagaaataacaaaattgtaagtaaatttacttgattttcttacactatgagatatttaatggttttaaaatagaaaatgtcagagtttaaagtaaaattaatgtaatttatgattttttaaatgtgtcttacaactagaaaataactttaaattattattagtattgtaataatttaaaattattaatattagtattgtaataatttaaaattaataatattagtattataaacagtttttaaaatataaaaaaaataaatttaaaatttatattaaatgattttaaatttacttaccagatggcagcgatatattggaaattctgtgtagcagaactgtatcttcaagctcttgaagaaaaagtggcaaaatagttgatctgtcttcttattatatacattttgaagcggatgtgatgcacaggaaaatgacgttaatatatcaaccaattaaaaaaagccaaaaaattataatactaaaaaaattagggtttaaccttatttgtacatgtatttttttaaaatattatttttccaataaaaaccacaatggatttatattttacgtaaacatgatttttgcggttattttatttcgaattggtatttaaatctttgaaacaacaggaattgcggttgtcttctcagcaagttctacacattcccactcgctttaggcaggaaagaccccaaccacataacccactgacatttaaacccgtgaaaacaacaggaactgcggttgccttctcagcaggttttacgggttctcacccgtttaggcaggaaagaccccaaccacataacccactaacattttaatatgtgaaaacaacaggaactgcggttgccttctcagcaggttttacgggttctcacccgtttaggcaggaaagaccccaaccacataacccactgacatttaaacccgtgaaaacaacaggaactgcggttgccttctcagcaggttttatgagttctcacccgtttaggcaggaaagaccccaaccacataacccactgacatttaaacccgtgaaaacaacaggaactgcggttgccttctcagcaggttttatgggttctcacccgtttaggcaggaaagaccccaaccacataacccactgacatttaaacccgtgaaaacaacaggaactgcggttgtcttctcagcaggttttatgagttctcacccgtttaggcaggaaagaccccaaccacataacccactgacatttaaacccgtgaaaacaacaggaactgcggttgccttctcagcaggttttatgggttctcacccgtttaggcaggaaagaccccaaccacataacccactgacatttaaacccgtgaaaacaacaggaactgcggttgtcttctcagcaggttttatgagttctcacccgtttaggcaggaaagaccccaaccacataacccactgacatttaaacccgtgaaaacaacaggaactgcggttgccttctcagcaggttttatgagttctcacccgtttaggcaggaaagaccccaaccacataacccactgacatttaaacccgtgaaaacaacaggaactgcggttgccttctcagcaggttttatgggttctcacccgtttaggcaggaaagaccccaaccacataacccactgacatttaaacccgtgaaaacaacaggaactgcggttgtcttctcagcaggttttatgagttctcacccgtttaggcaggaaagaccccaaccacataacccactgacatttaaacccgtgaaaacaacaggaactgcggttgccttctcagcaggttttatgggttctcacccgtttaggcaggaaagaccccaaccacataatccactgacatttaaacccgtgaaaacaacaggaactgcggttgccttctcagcaggttttatgggttctcacccgtttaggcaggaaagacccgaaccacataacccactgacatttaaacccgtgaaaacaacaggaactgcggttgccttctcagcaggttttatgggttctcatccgtttaggcaggaaagaccccgaccacataacccactgacatttaaacccgtgaaaacaacaggaactgcggttgccttctcagcaggttttatgggttctcacccgtttaggcaggaaacacccagaccgcataacccactgacatttaaacccgtgaaaacaacaggaactgcggttgacttctcagcaggttttatgggttctcacccgtttaggtaggaaagacccagaccgcataacccactaacattttaatatgtgaaaataaacaggaactgcggttatagtttcagtacattctagagattacatcctgctaaggcgaaaaacactttaaccgcaaaagccactgatttttaaacttgtgaaaataacaggaaaccacagaaacgtcaggaaaaaaacgttgttttataattatgtccataaaacatgcaacataatccaaaccggccaatgatttttctgcttaaatgtaatttaaataatttattcatacgtaagttgttatagccacgcctacgcagcaatgtatataagcagacaccgtcatttcgcagttagtctgctggaaagcttgtgaagactacataaaggtaaaaatttgacatttgcaaatgtattttataattacattattttagtttaaaaaatccaaaattcttaatagaaatttattgtgaaatttaaaagattttgtaaatatgcattaatatctattaaataattgttatttgacagatttactaaatgtagtgtaaaatatcaaaaaaatttaaaattaatttattctgaagtttaacattttttaaatatgtatttaattattactgtttcatctatttttagtttcatttgatacattgcgtaggtttggaaatgtgtttcgaaaattgctgtaaaaattattgactcttttttaaatttatagaacattggatgtaattgcacattcctggaaaattcaaaaaaagaaaatacagtaagtcaatttatatgtattgattttaaatggcctccaataaatatttttagccagtttaatgtaaaacaaagcataaagtttatgtagttttaaaatgatgccatattttaacgaaattcatttaaagacagtatctattaagaatttaaatgcagttctatggctttaaaaatttgtacgttttatttgaaaagtttgctctatttgaaatcaaatgttttagatatttcttttcataaattcagttgaaatatgtttcatttataataggtatttttctgtttctaaaaatagatgataaaagtcactagatagaaaatatcttataaattgttatttagtagaataaacatctttttatataacaaaaacacaaagtacatgactttagaaagccaactaaatgcattattatttaaaaattacagaatcaacgagtaatgtcactatagttttttaaagtaacttttaattgttcacttctagttgtaatcaaaagaaggatggagagtggggatagtttcggaaataatcaccaagtctcatcgaattcagatgcttttcaattccggcaatattcaacaactgtagatacttttgcatattcatcaatggatccttcaaattgcatgcttaatgaacaaactcatttagaaacggtactagtttatcctgtttacaacatgtcttcccagcaaacagtggagagaaatctctatgccaataatataggaaatggaaatgtgctgagttattgtagacaagatagtttgcaaggaaaccaaggaacatattttccaacatatcagggatttcactcaaacactcctcataacttttctatagagaattttaattttggcaccaatgtcatcaggcctataccatttagaaatgagggagtagacgcatcaacatccaaagattatggctttaaaccttgcattacaacgatgcaaatacagtttagtcagccatctgcttttcaaacttattctttaatgaatggaaattttagtgaaaatggttatggatacaatactaagattggtgaaaattgtgctatgtcttatgttgagcaagagtctgtagactcaaaatatccaaacaaagaagttagtatctcttatcaaagaaatgaacattatgatgagaatctcccgacgagagagcttaatacagattttccgcaatataatcaaagttctgtgttacagcacacctttgcgaatgtccaaagcattatttcacagcaaagtccatatcagttgattggaaaagaaaacagctttaacaactatctggaaacagctaacgttgatagtgattgtcaatctaacggggggcctaaaattggcctagacacagatcaatctgttttttcagatgaagtgactggggcgtgtgtagaaaatgttcattttccaatgaatcctaaaaatgagtatgtaaataacatatcacttgatgtacaaactgaatttcctgtgactgagaatcctcttgtaggagaaagtcaggctacaaagaacaaggatgtggacagtaacgcagaggttaataatcattctaaatatcgtctattgaaacgcaatattacaccgaccatgggtaatattaaacatttaaattttagttgcaagatatctaccgaagaagaaaggaaaacattttttaacaggttgagtgagctattgaaaataagggatgatataaaaaacactaaaatttcttcaaaagtggattttattcaatctgaagcttctacatcattggacatttgtaaaaatacattcaataacaattcggattcatcggatgtggacactgatatccttgcagacaacccattagtgatatgtgaaaatgaactgatttgtgataacaatgaggaaaacatcaagtttccgcctaacgttgaaaaagaggctgtccccatgcagacggttaaacgcagctttccagaaatctgtccagagcattttaaaaaaagaagatttataaatggtgatgtgatttatgaagatttaaattctgtttataaagtgatgccagcaagtgcgacatatgacgatgtgcgtttcggagaagtggattatcaaacctcttcggctcagacaaaaatttccaaccaccagttagcgttgttgccaacaaattatcagcacatgatagggcaggaaacagacatttcatcgcgggattatcacaatgacagtgctcaaattatttacaattgctcatttcaacgacagggaaaaaggcttcttgctgatattccatatagaccttggttaaaagaaaatgttcccacaggggaatatggaaaaagatttgtcaaaacagtccctagaccagccagtgtttttatttttggaagatgtcgaaaaaaaatgctgagggaaagcgttaaatcttttatgcatttaagcaagttacagtatactaaagaaagtctagaagcatatgtacttagaaattgtaacaagtttttagatttgagttggccgatacgacacaagatctatattatgcctgatgtgagtagaaattataacattgaagaggttaagaatttatttcccgtaccggaaggctggatggtaactctaggttttgtaggaacagaagaaccggtgaccaaaatttataacattgctgtattgttatgtgaaaatgggtgggtcatgattcacaagaatgataaagtggaacctgaactttatttagctgcttcgaatctcaatgaacttatagaggatggactggcacgctgtgattgtatttacgagaaaaggtctgtaccatatggaattgtcatggaaggaaaattaagacagtttatggacaattttggctcactgcaaagtgtgctagcctacagaaagtatttacatggttttctgtgggcttttaatggcacacctggaagattggcagacagagtgttccatacttgtgtacctggggttcataatgcccttcccttagatgctgtgattaaacatgaaaataatcccttgtatttcattggatatgtaaccacctttaaacagcaaaatgatttcaatgctaatgttttcatcgcggtagatggaaatttaagcatttatggctatcatcttatatctcaaaaaacttggtttctagcaaaaacattttcaacttttctgaaaatgggaactagaaagatgtactatgattatgagattccacttaaaattcatttaggagatagtgcagattcatttctgtcttgttttaaaaatgccccttgtctgctgcttaagccagaagtacttagaaagcaatttcctaaaccttagattgttaaaacttggataaccaaactatattgaattatgtatatctttttattgaatggaacatgtttgtaaacatttttgaagcttaaataaagagtgttttcaaatatctctgttttgtctctttacagaggacttgaaaaattttttactgtctttagaacttgcgaatacttgttgagcttttctttccgggtaacgcatctccacagtggtgcaggtcgcttcgtaaatataatcaaaaaattcttctacttctagtagttttggtgtcggatcttcattggcgccataatttgaattaattctagcagcttttattccttcccaactaaaagagaaaatgtttaaattacagtaaattgcaactggcattccttggaaaaatgatgctcacctgaaggctttgtttaaatcaatccacggtggcattggttgagtctttgtaggtttgttgttaggcgtaggtttaatttcatgtatgattgttgtactcgtatatataggagtgcagtatgtaatacctccggcctgatatatgctgcgaacgagaaattaagaaatgagtttgtttctaagacgaaaagtattgtcccatacagtaaaaactcacatgtttccgtcgtcacatgtcagttctatcacatcaccgtctgtaaatcgcaagtattcatcacagcaggattctagtttaggtaattgaagttcgctagctagaattaaaaaaattctatacaatatacagattaatctatatatgcacatcatggacgcattttatggcttcgagctatacactcttttgttttattcatttctttaatactttgtattttatagaaactaaataagaagttttaatgaaatgcatttattaaccacccataacattttgtaacttttcggatacagtattgttaaaggcttgagttatatttccactgttacacagttgagcatttaaagatttgttcgagatgagtttttttgttgtccggtcatctttttttaagaaagtcaataacagcgtatcaatagtgagtagtcttccgttgtcaaactctgtttttgcactgtcggttttaattttaattgagctggtatgaaaaaaaaacacattaagttttcttgttagattcttatcccccccccccccgacaggagagttttcaaattaccaaggtccgaaatctttagatggtgttagtagtacatcgtattggagatccgttgtagatatcttagatggaaagtcttgccacatagcacttacgatggctggatcgaattctctaggatgaagaagcgaaaattagattatatctagttttgctttctaagttaataatatttacaatttacctgttactaaacgactgtcggtgcggatgtggaaacatgtcttgtacagtcttttgtccaatagtgtcgaataagcgttctatttctagtagtgctattggaaaaagactgcgaaacacaatttatttgcttattctctccagtttttaaatttcgagtaataaaagacacttgcttttcttacattacggtggtgacgtagtttcgtgcagttgtatcgtttttaggcgagcaccaaatttgtccatatgtagactggaatctaaaaaaaaaaatattgtcaactcaacctttttgtcattttgttgattgcatgtatgtgcggttttcctcttttttagtgtgcttgttaatatgagcagttttgtgcgacagtacttacactgtagtgtttgttaagcacctttcgtccgtgggtatctgtctaataatgtctatgtctctccagggttcgatggttgtctctgtccagggatgttctgaccatcgccacgcgtatgtcgtgttttctcgacttttgttcttatccgggcaacaagcgtcatacaatggtttttctgaagtcatgttcactttaggtatgttaaaatcttcttctttccattgtgaaaattgcatgcaagtttcccattcgtagcccttgttgtcttttcggacgattgccagtgatatttgtgtccgaaaggctattccgctgtagctacgcatctttttaaaatctgcgcgtatctgtaattcactaataagcgggtactttacattcaaattcttggagaaaaaaataactatagatagtacctttttttgcttaccattgagcagacgactgggtgtattgctcacgtctttcccaacggtggcgagcagggaacaaaaccaggctcgtcaaaatgtttgcggtgttcattcttttcacatacaacaaactgttttgtttacttccgaatcctccattaagtagagaatagtgtaagcctgtagttactgacaagacttcagacagccctttactcataattttttctcttaatccgcgcactcccaatgagttctcttttagtggaatgcagagtgttgtttctaataatataacccttagaagaattaaaagtaaggtgtgagaaatttacttaaaaagctcttcaaagtcgtcatattgtagaaatcagtgtaaccatttttacttactgtgcttcgtctggccattcacattcgcaggaaaacgatgtacatcttgtgtattctaacaagctttgtctttcctcggaacttagaccaatatatctagtagagcttgcgttgtgcatgttttcatttattaagttttcgattatatcttctagagttattgccgtgcgtgctttttcaagtgggaccgtattggtacatatctttatgagtgatgcgaaaattatataatgcagttgcaccattatctgcgaagagattttttttgcagcgtctttatgtgcaggcttattcccccccgtttcgtatttcaaatcctaaataacccccggggggtaaaaaaagggggggagctaaccctaaccctaaccctaaccctagctctaagcctaaccccagccctaaccctaaccctagctctaagcctaaccccaaccctaaccctagctctcactgtcaccctaacactagctccaagtcatctgttctagatcctatccatatctgccctgactcctggttccttaccgctccgagccccaccctccgtcccgccctcctcctgttctccatgccctgccttctcaacccttcctcttccacgcccacattgcctctgcactccgcgctctcttggctgtgcgccctgcctttccgtgacctactgggagcgccgccaaatctgttttgccccgcccctgcgcgcgcgggaactgtcggcgccgcgctgctgctagcccgccttccagagctccctccctccgtctgcctcctcacccttgccactcacccttccatctcttctatcacagactctgtgttacaccacctatgactgctgcaaccacagaacattttgctctccgcgcggcactcaatcgttactggtggctgcttctgggacgacacaagctcagtttggtatgcaactacgtcacagctcatcgccaacagttactgccgctgccgtggcccgaacaggaatttctccaacttgacccggccccctactccaatctccgcaaccgtgtcgctcaccatctccatcgcggctggccagcggcacacaacacatgtaagctaccgtacatctctttcacaaacccagggctcacatagagacaagcacaagctcgcgcaatgacattaaaacctcccatcattgtcctttcctgtcgctttgccgataacgtctttgctctatcgcaggtttcgacccccgtccttacttccccaatgctaaagtcaagctgcttccgctcggctccatcacccttaccagatcattctccagtgacgagcctcatcctattggtgatgatgtgcatcacagtcatgaccggggtgactaccatactgttatctgcagctggctcacaggaacctccccgatcctagtgctgcttcaaggaccggacggcagcatctattgccacgacgtgtaccgcggccgattgtatctcgtggcccactctgtatcgttgttcgccaggctaggccttcgccactgcgaacctttatatgcggcacccagatggaagcacgttcctctgcccaacatgtgggtggcgagcccgccagcgtccgccaccctcacgcaaacactcgccgtgagtgccacgcacggtctggacgcgttatactcgctgctaaaaatccacagaggaactccgtgttcgctaatccaccccgtgaacggctacgtcctggacatgatactgacgggccgctcattccaagaagcaccctgccaaaacactcgcacgtccgttaaaacaacgccacatgtaatggacgcagtctgcggtggccgcgggtcatggctgtccatcggctacctagtaaagatgccgcacattcacctggcggtgacccgaacatgtctggtcaccgccatagatgtccgacaaaactttctgtggcgcgtggcggacgacgcgctgctattcctggtcaccggtagtcttttactactgtcgcggccgaccgcagacttgacgtcttggtcatgtttacagcaagaacctgtgtggaggaactgtctagatacgcgcggagaacaggatgagacagaagaccaagagatgaaacaaagcacaagcaaaaagcaaaatgagaataaaaaactcaacacctcaaaaaaacacacccgcgtatcgtcggcaattccgacctttcccctcagtctccgagaaacgccgccagaagccaggagcccagccgtcctcgccgccgccacccagtctcacaaaactcgagcgatctcgacgcataatgccacgacaacaataagaataccgcgccttcccagttacctgctggaagcgcgtctcttgtccgtgacagctatcctgaaagacacaaagaaaaaaaaaacccagcctcaggcgtagcagctgcgacgtcagcgcggtgtctgaaagctcgccaaggtctcgcgtaaaagaacagatgtgaacttcagatgtaccaaccaaataatacgggttccgctataaaaagtgcacctctattcccgttcttatccccgttctaactcttccttgtatcataccttgcatgttaaccggatcccgtggatcttacacacatacacacacacacaaacttggtgaggtaaacacagagatctcactaactcataatcccctacacgcttaccaccacctaaaaatggttacaaccaaaactggcaatagtctatcttctttttctttccattcacagccaatgtgcagtactcgtgggtccacaacaacgaaagagactgtagagacagttcctttaagtagaccttagagacacaccaaatacaaccacaaccaaaaaaaaaacagaaaacaacacaaagccaatgagtgcagaaatgctccgcgctgttcagctccagccaagacgccggggacattcctcatctcccacttcccctccactcgaaggagagcccagtcccaagagactccaatcgagcgacagtcaccaagggcgtagaggcagacctaaacccagagctaaaacatggagcgaagctttatcccaccggtccttcctcaacatttacgcgtggctgtctttgagtcgagggtctccgcgaaaagtgtacggatatgccttcaggcacagaggagaactcgtagcattgccatggccgcctaactggagcctggaacttcaccacgatccctatcgagacgccagagcacaaaccgtttggagtcaccgctggggatggcctgcaacacacgtgacagctcgcacggtgcgggactgcggtgagtgtaagcagtgtgacacattgttatcgcaattgtcttacccgattaactttttattaatgtattaagcactctttcttcacgtgtgactgttgtgttttttgttgttatctacatcccggcagccctcgacacgcatatgtacgtgtgctgcggacgcggagaaaagttgcagcccgtcggatacgtacgcaacagagccgcgccttcagacctgaactcgttacgcgtcctcctcatagccagggacggagcaatgtatgtgcatcacatgagaacggcgcgactgtgccgcctggccagcagtgtgaccgaattcgcgcgacgagggctgcagcgagaatccgaggtttatgaagatgatgtttccttgccagaccgtcgagtaggttcggcaacggccattcacctgtttgacgtaattacccaggcagccgatgtccacgacctactcaccgtggccggactgtgtcagactcacaccggcgtcagctgccaactgtggtatacagaccacgatccccacaccgtcgctggggcggcacgcttcacactgacggtcgcacggcagcagtatcgattgtggccaaacgcacgacgcaaactgctgcagcacctacatccggaccacccacttgggctgtggctgttgtgtgccgtgctcacgtacgatgcaaaagagacgaatcgcgcagtgccacccgtaacgccaggggccgaaaccgtgtgggtgatagttactggcaggggtgccattctaggattctggccagagagcgccaaaatgtgcagattggcctcgtctatgaaaggactctggaaaaacggagcgcgggcgctaaaaggtcactggacatacgcagcacccggccggcatagagcgggagaggcctggcctttgtgtgcacactaccaatctcctagatagaacaaaattaaaaagattaaaaaaaaaagaaaaaaagtacaagagtgttatcgcgaaacagcgtgtcaaaaaaaaaacaatccacatactctagaacaaactgtacccaaaaataagtccgtgtgcaaaactgggaaaaaaaaatcaccttcctcgttgccactagagggagtaccgaaagtgtaggcaagaaggccacgctgtaaatgactgtcagcgtttggcgctgaaaacattgctgttcttgctggctcaagcacaatcacgtgattaagattcctttcgttttcaaagtgtgcccgggaggcagacatgccctttctcgtgagacattatgagatttgcctgccagagaaccacgtgacttggacttactttcgttttctaaacgtgccctctaggcatgaatgctctttagcgttagccatgaggctagcgtgatcctgtatagtacataagtttctaagaatatgtttttaacaataatcatgtcccaaaaagtcgcgagtgactaaaattctctgtaaatgaaggcaaattaaacaggatacagacagttgtggcagtggtccgtttcgtctttctgtgttttccttacgcggctgacgaggtaaagtgtctcagtccatattgttgtctgtgccaccgtagttagcggtggcatactaaaaactccgatagatgcagaacaataacaccgaaaaccacgctgtggaaccagaccacactttataaacaaaacggccttatcacctggaaaaaaaactaaaaataaggcaatgatacacctgactttccattggaaacctgccgtaaccctgaccacaaatcccatgctaaatcccctgaaacactgccaaacgtcgctacaaggtttttccgggatcgagccgcagcaagcttaaactgaggtcacacacgactttaattacggcaacgcacagctgtaagctgcaggaaagatacgatcgtaagcaaatgtagtcctacaatcaagcgaggttgtagacgttacctacaatgaactacacctctaagcataacctgtcgggcacagtgagacacgcagccgtaaattcaaaactcaacccaaaccgaagtctaagtctcaccctaatcgtaacagtaaccctacaactctaatcctagtccgtaaccgtaaccccaatcctagcccttagccctaaccctagccctaaccctagctctaaccttagctctaactctgaccctaggcctaaccctaagcctaaccctaaccgtagctctaagtttaaccctaaccctaaccctaaccatgaccctgaccctaaccctaggctgcggccctaaccctagccctaaccctaaccctaatcctaatcctagccctaaccctagggctgcggccctaaccctagccctaaccctaaccctaaccctagggctgcggccctaaccctaaccctagggctgcggcccgaaccctaaccctaaccctaaccctaaccctagggctgcggccctaaccctaaccctagggctgcggccctaaccctaaccctagggctgcggcccgaaccctaaccctaaccctaaccctagggctgcggccctaaccctaaccctagggctgcggccctaaccctaaccctaactctagggctgcggccctaaccctaaccctaaccctaaccctagggctgcggcccgaaccctagccctaaccctaaccctgaccctgaccctaaccctaaccctaaccctaaccctaaccctaaccctaaccctaaccctaaccctaaccctaaccctaaccctaaccctaaccctaaccctaaccccgcccccactggcagccaatgtcttgtaatgccttcaaggcactttttctgcgagccgcgcgcagcactcagtgaaaaaca

SEQ ID NO: 2 - protein, 169 aa, herpes simplex virus 7
PPGGKKRGGANPNPNPNPSSKPNPSPNPNPSSKPNPNPNPSSHCHPNTSSKSSVLDPIHICPDSWFLTAPSPTLRPALLLFSMPCLLNPSSSTPTLPLHSALSWLCALPFRDLLGAPPNLFCPAPARAGTVGAALLLARLPELPPSVCLLTLATHPSISSITDSVLHHL

SEQ ID NO: 3 - protein, 400 aa, herpes simplex virus 7
RLCSIAGFDPRPYFPNAKVKLLPLGSITLTRSFSSDEPHPIGDDVHHSHDRGDYHTVICSWLTGTSPILVLLQGPDGSIYCHDVYRGRLYLVAHSVSLFARLGLRHCEPLYAAPRWKHVPLPNMWVASPPASATLTQTLAVSATHGLDALYSLLKIHRGTPCSLIHPVNGYVLDMILTGRSFQEAPCQNTRTSVKTTPHVMDAVCGGRGSWLSIGYLVKMPHIHLAVTRTCLVTAIDVRQNFLWRVADDALLFLVTGSLLLLSRPTADLTSWSCLQQEPVWRNCLDTRGEQDETEDQEMKQSTSKKQNENKKLNTSKKHTRVSSAIPTFPLSLRETPPEARSPAVLAAATQSHKTRAISTHNATTTIRIPRLPSYLLEARLLSVTAILKDTKKKKTQPQA

SEQ ID NO: 4 - protein, 79 aa, herpes simplex virus 7
MLTGSRGSYTHTHTHKLGEVNTEISLTHNPLHAYHHLKMVTTKTGNSLSSFSFHSQPMCSTRGSTTTKETVETVPLSRP

SEQ ID NO: 5 - protein, 162 aa, herpes simplex virus 7
MSAEMLRAVQLQPRRRGHSSSPTSPPLEGEPSPKRLQSSDSHQGRRGRPKPRAKTWSEALSHRSFLNIYAWLSLSRGSPRKVYGYAFRHRGELVALPWPPNWSLELHHDPYRDARAQTVWSHRWGWPATHVTARTVRDCGECKQCDTLLSQLSYPINFLLMY

SEQ ID NO: 6 - protein, 262 aa, herpes simplex virus 7
MYVCCGRGEKLQPVGYVRNRAAPSDLNSLRVLLIARDGAMYVHHMRTARLCRLASSVTEFARRGLQRESEVYEDDVSLPDRRVGSATAIHLFDVITQAADVHDLLTVAGLCQTHTGVSCQLWYTDHDPHTVAGAARFTLTVARQQYRLWPNARRKLLQHLHPDHPLGLWLLCAVLTYDAKETNRAVPPVTPGAETVWVIVTGRGAILGFWPESAKMCRLASSMKGLWKNGARALKGHWTYAAPGRHRAGEAWPLCAHYQSPR

SEQ ID NO: 7 - protein, 451 aa, herpes simplex virus 7
MAIAESGAFEINVNLGKSIASIQKNPIIYMRRHLSFYVELLKFIIHQYEQCFLPPKGTILYHNGLIELNTLIIDLNQQITSKQQIYSWTSITLPKIFSTKELYFIVASPESENITLNPAVTKGGWLSGSFSFPLSLSCAYALTGVSSTIYMLPFIPYKFPMTYVDFSTLRTYEVTSEYGSIQIIKQRNFLFLGIIRDLSWKSQRDNKNFILKAMFVGNWLGIQIPEAFALRLFNNTRFSIQDFEFSINIQNINLTRDNKILGSLSTVSCDQMPPNLSPENLPNYLVIQFELVSTLANPDHLLFSCNPKLFFTGDILNSAINLQHSPNHYELTVYAPHNLHFYPSCFHIVTLPIQFSSRNDRQMLVSSYPNEGYFEVQMCPWVQNSPLQIVIKSFSKNLVLPQGTPIAILLYMEKMTTGKNSLRDQELKINKDITRIGNVNLPKENFLHYNS

SEQ ID NO: 8 - protein, 346 aa, herpes simplex virus 7
MICYSFAKNVTFAFLIILQNFFSQHDEEYKYNYTCITPTVRKAQRLESVINGIMLTLILPVSTVVICTLLIYYKWTKQTITSPYLITLFISDSLHSLTVLLLTLNREALTNLNQALCQCVLFVYSASCTYSLCMLAVISTIRYRTLQRRTLNDKNNNHIKRNVGILFLSSAMCAIPAVLYVQVEKKKGNYGKCNIHISTQKAYDLFIGIKIVYCFLWGIFPTVIFSYFYVIFGKTLRALTQSKHNKTLSFISLLILSFLCIQIPNLLVMSVEIFFLYIANTSCLGTIQREIVQIISRLMPEIHCLSNPLVYAFTRTDFRLRFYDFIKCNLCNSSLKRKRNPLTIKN

SEQ ID NO: 9 - protein, 98 aa, herpes simplex virus 7
MTLNQQPSNCRLITANDPVLASNFTMQPTFKIADKKVVLRDHNYIAVKDFVLSRSFMHCIRCQEKIEKKTSDSIRAYSIKPDFMFYDSDDEVRSSPFL

SEQ ID NO: 10 - protein, 648 aa, herpes simplex virus 7
MEQQKGFSIPFFVTDENCNFVPEILPRIHTKFLKDVLIADSYNSVSWANSFIPMPIQTLEQIMVLITKFKFSRSRDFLFPVIRLAVHINRFHTGKKQLKTMIEIMKSLFNTEEAMRRFDEALMILFSNEQTNTYMTNIALSMHENGLPDSKFMNALKMIYRAGNSFDNQPDNDIESYNEKLKIYNYLIKIPKYTLKAGVDLYNENIKDLSIGIQRQPTLLFTSRNDFSLKAIYNDVLFLVSAWNMIINYKKEQRRLFSWITFEINSLMENVVLAAFQLPDLKEMTLDLSALIANMNLLKPNDDYSPHFKLIINKFFEIGIFVTKSYICILPSFVKSQLISFENVLSSNRHAEDVTFILTSSKESDDEYDEDKPPRQVDPDRVDNILMESDFFNVKPENAFSEIALMPISHDKIIDVNNSNIQVLETELAHTNLFVYSAIAQKYDLPLKEYVERLNVYNPDLSSGNSTPARNSNSIHTTPVLNISRPGSTTPSGNSARYGNNTPRSITPVLEISRSRSATPSGNSEIYENRTSPTFRVSRSATPIERSSRSASIISGESVPGFFNDQERLSTNSPISINGNTPRQQSHGDNEIQTIDSTDEDSMNAPQSPQSIYSISSYVSTDDQLLHSPTNSPFNLFDSVSEMQEDTE

SEQ ID NO: 11 - protein, 89 aa, herpes simplex virus 7
MFPLIQNAEEKAYTYLFFILSKNGPRGEQILTVLDYTRFKFFDGSVTIAHSKKNYFLSGSLRYKKDDYDVIQKQKGKRITCKHSKFIVC

SEQ ID NO: 12 - protein, 938 aa, herpes simplex virus 7
MDCTNLQFESILNLLKTDVSDNTFLTITAKIEIFSLAAESITADKILSFAKLLPIHNYHFNFIKNHMVFYILNYSTLGFAKRFSIAETLCRELKIFHRTFQSTSKLQNLNNAEVLYQFEKLIESIQVFKAELASPIGKLLRQETMIYDKPTEKSVKYVIIQQNLIKINNLIQDCESIKNCRLIAELIDELYQKVYRWFMQIFTYDDIIFPNDNFLDRLLKMDFCYTYYTASNQHLLSLFEQTIDNQIFIDPSPYFEINPVYSPELQFMSTFSLKIFSKNISAKNEDLYIYPLLKTNFSILTFLSLENIFFHHGFIYHILHRTNITPTEEKKLGKINGFLNTVIQQVLIKKNNLQITFPELLDKIYHLHRIGLNIETAQIFLQMLTTYKPATTNNKLQTFFTNFSIIIFSAYIFFLCIELFSPTFIFHNKKKLILEKQKSIILILGEQFSFIWKEVNEIVDLLFSSTVTETYFKFYSKGADDYEKDFLYKDLMEKWGELFFPLTYSMTTPQKYTDKHVSSTVLKNLCDTAYQSKMETAYESLLPYITHPEFKFIFITHYVRPSLSLITNLTFEEIKDNRRLLILIFACKLLMPSNYLLSHYLLLLHAFTLQIFKVDLGHFSIIHAITQKIFDNINSLTQTIFIPKTNFLVSLLLTAYTVHMQTYVNPWIQKTISENIALLKEYIDFTKKCSSTLATTCYLNLENFAVNMYFGKNKVGSTSLSAFYRTCSKLIEESKLFKDRLQEIKVSKTLFIEMLQNVVKNITKFKDLVSNQTLQNFIIIVERISSHANTTYQDVLNSIDECHFSNMQLIQSFKNIVYVIDVLNTKNIFNFSLASQLIEAKKLVKKQDTYNQLNVQDDFVTVLKSHLNNLFEKQKPTINIERRFMLEGIPDIKQIPFLDVFDERYRLIPQIEKYLHWYIAYSEAAQADLVEPLLLKLG

SEQ ID NO: 13 - protein, 2059 aa, herpes simplex virus 7
MRIIAGSTNQNDPKYGPRAGKQCMSNCFSFLHTVYLNGINNVLNKESIDIIMENGALLDNISTTTLKLETGNIPEYRFFTEIPKKISSNFGETIHELSRPFNGTLESQHIDNEVYLGLLDFLLYGKNKKPAFIVITIGVMARAIFIVDELFYLFDSHASDTENSAAIYICEDIDELYALLAIENVAEFYYDAVFSYFIETTDLSLEDGDATILILKTYKDPDIALSLNDFLTMYSSTSSTKTAETNTLISKQSPSKRKQEKTSLNSNSLEKKRKQGSSLKYYNNEVDLVPSFYELRPQFNNILFELSNFPIVKENVNWTLYIQKFATKSTQPFTKPFIWNRVFHLFSQVVDALIMIKNDHWDETQQQKQFFTHFLPFKEFSEEFENAIEACRENNLDLILLYKNYLSKTTAFKNLERILLTKFSAIVSPVHEKHYTLVNTWLTNLIQKLVKHPEDTNAFINDYVLKNPLNHFICLNKKEKQSIALLLNKKRMSMLKDVEIEKNGFVQLQAFIENIGEAPANYLDPENARKVNVEEVSEKDIPTLSTDKVSIPNESMFTSNKKHSIEKLIHAKLKAILSTMGQRLTRIIQENYNNIAAGFLPVNDLNNLFAYLVKLYFDVYSITINGFVVENELIKNIEQIYDNTQYLRFGLTRFNMQNLTPFTISVRKMFLDFFLSQKTLIDRAEEIIENLEFKSVTPEGKQKLATKNMLREQLEQLNAMDVDDTINLKTDTLTHQVLFSDQELRMIQDFILQLSIHNIPSINFVKSLKLHIILEKRPDILLALQEKVQNILYFYFQDLVNEIPAQENVLSTMLFIIELFPADSRIHLLETGYISRHIVKKWLNMKSLQDAEDLIRFININKEQLGKFEHQPFGKEIQKLIEKIHLFYKQKVIEYQEDVWSEMAKNIILTSPSELSQFLASAPTQRIIQKHKNNLDQKLLIHMENQAKQAMEDDKKRVACSKINLERHLNDLLLLLKDRQFASIQASVLIVCENIFKTIPDDNLIIQFSHALLSVLLDIEKDLKSYSSEILEKILINRPLETSRLLVFKDAYGNLKEFLNALKQSLFATADVQNKADFLIQILDFTYKFRHKTNKGKLLHSIYNEDFKLYEETLTELRKKATDAKESLTKLFKASEQKIELSRTIPLKEIYLNIETVNFQGYGNVVFRESAFKRAIEVEIKNYEMKLNDLIKHFNSHLKTKIDHIQILNLSFDNKWKDFVSKSKISFPPELTISSQELIKDPIKVITETLNKASNDLAYVISEKILKWLIVFVKELNTFFVATMSEFGEVIPFDYKHFRALEYEINSKYIEIENKIICNEIIENTDNIEKLSTLIKQIDPNRIAGGKQKFQDYLSKILTAETNQQQTRYKEQLKKQYFDLLDNIAHFRFAFDFNHQQNLILKLKDKFKTLRTDTVFERFPNLDDTFVSSMNVENFLQALEALSHFVQAAQNFLQNVLTEQADLFPQTNFIPVELSTVKTIPKSDINLRMKIHTPQTFFQVDSVFNTQLIVDEKGIPVQFYNVFHNIVFKFFALNYKKIIVPDKVLNLVSTKYKILTTLKSILSVVKSFWKEIINFDLTSYFQGKAEFTFQNVFPIINLKIFIYIITQAWSVTSDETQHSFELPLEKFSLLIIANNPEFLFGSLQCPVDLAINSLIPLLEKKKYFTAFTISDNPPKLSMDELKIVCLDLNTWSEITLEKYTFKKNSLMQLCMGKEKFFIYLLSALVLPQNFLNYIWIQYKPSCCAQDSFQQLIQDLCFEYTHQNHIKPISLNLQEPNALKHGERILSKFVLEKNANTSLFSIFLGKQFLLDYLLFSYLTATEMTFSYYVDSIKNFLLTIRHLENVQQNVDFRTILQSRNFDLKYLLTQSWTQNVLEQSIFHVQLDKIIADIKQPQLSLKKIPLVLFNGDNEVVSTYVPPEQASQTEQSFRIKNIFPNPVQEYSSKNVILFTNYPKNTKFLFNSPPPKTAAKSYKLPDTTDDINTETLSSPTIQRIPIKGLVPKENEIVFLPEKNTAHTDSKETKTHLIDTFNILSQTKGEIKTFSTDFDQTISKLKHLYF

SEQ ID NO: 14 - protein, 485 aa, herpes simplex virus 7
MAYKGWNSDSFSMNSELFNEILLYAHLDSSGIDSDDLNTNPNTLENEINSVEKTLNIEELKKITTALNIDNRCNICSIINICLRHETDKMWIYDYALLCYKCNAAPRTPLAVVIIATEFMQLIQKHFLNINFDGLFLNNILSILDFHVHFFINRCFSNTNDDLLHNENITLYHMAILKSLLLEDESIPNIRIKKFKLKGKPTKKQHGNAILEKQTLPLNTHFTHLIFYMWAGTNIFDRISLTDLAIKKRQILKAIYSTKNELNCSAGPILLSQIPISITKNATSSVCLLCELMTSSQKNFDLLQFIYTSVINYCQNNLKMIDRIQFVLANLLDLARIYTNVKTTSDCSKIVLANEQEFSNSDFVIDCHSFLILKQVGPVGLYKHFFCDPLCIANIKTIKPHILFYTTESCILQDFKVAICYQNEYLNSVEKHVWLAIHFFKAFQVSKLNHKNKTLISDFLKDFTQLLADQNFEIVDPTFTIHYYV

SEQ ID NO: 15 - protein, 259 aa, herpes simplex virus 7
MAIQSTRRLRRASSLLKKSKPYNKEKTNLSLSLSLKELHSVFKLFPEYELKFLNMMKLPITGKEPIKIPFDLSLHHQHTCLDLSPYANEQVSKSACVNCGTTNIPTASDAMVAYMNQISNVMQNRLYYYGFQKKVELIRMSAKQPTLFQIFYILSSIASNFLPIMFENNEKLNMYVVFQTRTLHIPCECINQIMTVSSGYTVLLDILHDSIVLHVLCKTIETSNIQIDINVLQRKIEEMDVPDEIGDKFEKLKHILPFI

SEQ ID NO: 16 - protein, 203 aa, herpes simplex virus 7
MGNCFVKKISSDIFNSNYQMLYSELSEQEDLLDFLETKYTDFGILKTDILNYERDSETFKTLLQVLPIYKKTKLRYNLIERCLNNCPPHVKDALIIEIMKAKKILETLDVVFMKIMIGEFTICSDNVNQLLNKFSIDQTTLCDMEKINTLIDLDEENSKRLLTEIDPLLHQETGLYQALPNAVTDPPSEQRAATKKCYEGFTK

SEQ ID NO: 17 - protein, 86 aa, herpes simplex virus 7
MTLYKIVSKPIILLAFFFTRVVFTNEVDGEELFYKPTCHSDTYEIILKKFSSIWILVNTFILLCSFSLFLKYWCFKTLAKETVKGY

SEQ ID NO: 18 - protein, 239 aa, herpes simplex virus 7
MSLEYLPPVRRRIGQYNHLRIYKKILLLKSNFEKLNFFLGNLFPEELHDSKIHVYFEVRLGCRIPDCIIVFRHFGEKLLKTFHCYFFEFKTTFAKSNLFSIQKNRTQKIQYLQGLRQLRQATDYLQQFVIKNESLCKVNPVICFFRQHGLKLDFVKTFIAKELQLSSTFLCNLFTKYQNDTVKSILSISNPTNFRRACQKYSNLYRGRYATTPKLGNSKTSKRKRRNSKKQDFKKLVKN

SEQ ID NO: 19 - protein, 294 aa, herpes simplex virus 7
MKNIDLTNWKLLAEIYEYLFFFSFFFLCLLVIIVVKFNNSTVGREYTFSTFSGMLVYILLLPVKMGMLTKMWDVSTDYCIILMFLSDFSFIFSSWALTLLALERINNFSFSEIKVNETKILKQMSFPIIWVTSIFQAVQISMKYKKSQMNLEDDYCLLAIERSAEEAWILLMYTVVIPTFIVFFYVLNKRFLFLERDLNSIVTHLSLFLFFGALCFFPASVLNEFNCNRLFYGLHELLIVCLELKIFYVPTMTYIISCENYRLAAKAFFCKCFKPCFLMPSLRKLQQPTKSTQF

SEQ ID NO: 20 - protein, 512 aa, herpes simplex virus 7
METVLVAGFLCVYDDNDINDNFYLPRRTIQEEINSGNGLNIPLNINHNENAVIGTVSSLSVYSTVCFVARVQSKEFLTIIKKIAAKSKLITNTEEKTLPPDPEIECLNSIFPGLSLSNRVGGNERDPFFKHVSICGVGRRPGTIAIFGRNLNWILDRFSSITEAEKEKILSTDQSCVQFFAEEQFKVDLYDLLADSLDTSYIKVRFPKLQSDKQLSGISKSTYIKASENLTANNHTINVNSKVTKETEATDSVSQDDCAVHAPDLISTICSTTHTTHHDLVRMNGSATGNSASLPAPQFSECVFLPKDTFCSLLNATAGAQNKNVTPAAPIFKTDEYITPYPESLSRVDYGNRMNYHIPPPYWYPSMPGFNYKSYRGSQKRCAPTDSDDEMSFPGDPDYTTKKKKRYREDDDRELTKDKNDIKELVDAIGMLRHEISALKYIRSQSPQRQHCTAVDTMPTIEEKNVASPKPSVVNASLTPGQDRNQNLMQSDQSLLSLNKKLFVEALNKMDN

SEQ ID NO: 21 - protein, 775 aa, herpes simplex virus 7
MIDSISEETLIVKSYTVNHCAKNVPVFINSYDLTAEVAKNEDVRLARQVQISLEKIDEVIESIFSASGPSVENVKDQAKFALCRLLLGPVSIPCYCEEWDVNFYLTKCSYNCEGPVLYIYKNASQCCESTYRFSIMTNYHSTHIFRGLLSLQEWNSHLSNILCTCSNVTGDKYTATIFPNNASIYLEYYPYFLCYLCKHLSIIDIEQCTNELIAFLGPKTSQRIIIHYKLLFGFRSKPMNFTVSLLEQVFTLEIQKLYYSVSKHNSTTADFFNVITAKFAEDKYFVLRTFKLSAQITPGIQSFCSLKFKLQTLYLNLKIMKNTKLSISNSFYHGKTLYTLDEKQLVWRNLLLIYYGYNLKDNVKQTQEESLLSMHYIRILERLSLKSFREINQQFSFEIPSYQEKTLQFIPGGNDFAEITSVTHGETTVNAFNTNRVMNVKAALSGEIHCVLHRIPKSMTHSFVMYKRTFKEPSLTVSTFISNDDFTTSSLNINIRGPYCDFLYALGVYRLHVNIQDFFLPAFVCNSNNSMDLHGLENQGIVRKRKKKVYWITNFPCMISNSEKVNVGWFKAGTGIIPKVSGTDLKNVLLKELISIGEIPNITFDMDLHALLTLLEKRNMHQVPFLIKQFFMFLRLGLLVGYGRKQERKVHHIMLFLIQKGFFDFSKNSVANSKIKHACALVGSRLANNVPKILSKQKKMKLDHLGRNANALTVLRFIVENGYYKRKTIFRKLLKYLATTSFNAHVQTESNRLLNLMHNDSKTNFSSLERLYTLR

SEQ ID NO: 22 - protein, 75 aa, herpes simplex virus 7
MNGVLNDIKTEFLCNTKTDLLTLIQKICLNCDFILEPVESFPKKTELVAVMYDTLAVEIFNDLLKYNEQKKDGLA

SEQ ID NO: 23 - protein, 439 aa, herpes simplex virus 7
MEMHLLCETMFTCRKNNILPVHLCILLDDVIHKEKVKAIEGIFFQCVFFKEKLVYTEWTKIKFTYVLHDLVISQIFKNACIKEVIHGALILSVPINIDNLHFDTDILILKIIYPHFLHDDIVIKLSEILSGAPRMQKTVEKKQEVEKPFFHIPAKLGDLTKEDPISFNHHGPLEPPSTVRGLKQSANVRHSHPISRPEKANVTFLSDSWYSQNLKCDFISDIQQRHVLVIFWYELSKGIQMQIKNIQIPPENLFSSITNYLDRVNTYLDEIAERTFRCITTNMEIQNRHLPQKFNSHFQIEFNCTHLISGMELARDFWILSLDRNSCVLKAMASHFLHKKKGRSSLSSNEFWADLIDCTTGKTLYGEKVRWQLNSETSLYSTFRKNQNISWELQPNCYALYMSENLKLYWVLPGGFCVSGTFKLKENDEFFFDWQFGMS

SEQ ID NO: 24 - protein, 346 aa, herpes simplex virus 7
MDTDIALAAIYKETTKLNEKDAKIFSEAVQTALTVCKATAPNTRLKLVETPTNNFLLVTNVVPSETSKATTEANLNIDAALEKLASSFNTAVPVKSSKKYLLQNVRKMTSENIALTGSYIIYTKKHIEVAFLLDKSDFVQDILRYAETPSLLGHTDVRDLECLLWLAFCGPMSYCQADNCFGLNKAGYNAPFPILFPPCMYERNMNLSVFFGLLQIYVFSLYRDFSVENSNLQQGIKKRIKLVLSDLRAKERICEEEIGNFPLAAQICLFCALYRQNRLCMEYAANNLSMSVFSPIILKDCTFMQTTVTITQILPGSKEAIIFPVYDIGKLLSALVFSENGVLLKL

SEQ ID NO: 25 - protein, 546 aa, herpes simplex virus 7
MEQLKTPQNQKTRPRNMLPKKKGKELKKRPCKVKRKLFGSENIRPNKKIPLASDVDNELEKKRGSMIRKRSETDLCPDPSVTDLLCHESLTVSPKFERDGLSACTEFENFMDTRKIVLSRNEKSVTDLSAHYPVLCNLGIFERIHSPFLFSIHIDTQSFSVVYVPHKESSCSQFCEPEKNMARILGSGSYGMVYDLNNVAIKASDDLESCISSYVSGVVRAKAGAQLTSRECVFKSLLICNSVCLNHKISLSKTYDTDLYKFTDWKLENVENYYSIFCNLAEAVRFLNMVCKINHCDISLANILIHHKEGIILEAVLADYSLAEVHPQYNGKCGILRQFDHRIQIVPKSYNKLCDMFNPGFRPMIAHKIILVEVYAEFDGKGNPVRHCNLDLCALAQVFLLCVIRMLDERGCREAQKYYENRLFTYSNEACTLNPIKYPLEYKDACCKVLAEHLVLFGILFYREVVDMFENLYDFLHASGDLSVRDLLEETYVNDSRDVRRQPIRYRHAQLQRHEIGQILLNDLQQLLSIITISDLEKDPYSVFRV

SEQ ID NO: 26 - protein, 480 aa, herpes simplex virus 7
MAIDYAQISCNLASIIEEDSVFLFLIDKLNNLDISRRKISFNFIRLCYTYYILIKFNSRFKDTFLARSFIDYMHQNISDFIDENVELSDLYSNIYVRLQDASPKVVKNLFKILERETRGQSTNPLWHAMRKNCITATKIYDIYISKSFSGIQEHSYLGDAVLYGIKHERIIEHLLKTFFVKKPWISKTLGLLLDPSSGVFGASIDSYYGISFNDNNLIEVGDKVVIFELKFRYKYLREKNDLFVSELLQNPSEIALAKFILSHPIPAIEYRENGKMPSAREYLITNNPLYDSGKKRRACLTPKNLTFDITRLIPMNEKNVSTAIIFDVVKDCILNTLVAYQKAIFTIDAFINPRHRYYFQSILQQYVMTQFYIQDHDNPENIEKENLPSVYIVSAIFRKREDDEKNCRLLIEDTEYLEEEIPLILLITPITIDAEFTSRVIKDICCIWENKIAQQTNLKIWAQSAVRQYMAASSARPKTP

SEQ ID NO: 27 - protein, 787 aa, herpes simplex virus 7
METQLQNDQLFLEWFGQNLLDCHFAQNVSVYLQDASMVHFKTFSEQIKIIRAPMGSGKTSALIEFLKTVSYIDSVLVISCRKTFAAELLNRFKKNDLNDFYLYSEIKERQINKNKLIIQVESLHRVTRNYHVLILDEIMSIIKQFYSKTMTKVKEVDAKLLTLIRNSTQIVAMDATVNRYVVDFFSLCMPHFKSALIINTFVSANFSNRSAYFCPTFIDGNLAFYGILKQKLGLGKNICLFCSTVTSADFMSELLKTDFPDKKILLLTSKQGKCHSVESWINYNIVIYTSIVTVGLSFDFLHFSAMFVYIHLVKGGPDMVSVFQSMGRVRKVTDNEIFIYLNPALIQVPLSVSPISIPQCYDWTLFEKSILQCSCMDFNKKCLSAQNYLSNSMIKQFFRIRHYIEKTTLLNLPDSLYLLCLLLDSNSIKVHIDGDVFPIAKEKFYAFTKMLVQGCHFFEKKKTDFVENTMTLKELFSNTNITVNGEFYELGNFQVHKDYIVNLNNFQNLFLKNDVDIFVIEEIMLTLKSEIRRFVFINALLQKYVATGIDVEKIKAFFKSRIKTFTLPENYICSKFYLLSDISGVHECGMLMDVAFLAESIRADLNLQSCTDTQTDISEDAILLCAARRSSEILRILQIVFTTHVQLFEKYNSYTLYLFNRLKGMQLNTWSLSIAKFSVSIIRMFFKCAFNMNLVKSKPRYIVGKPFRSLTKREIETLLDMWHVSRTNLKTYKELRKALTEASKKRQRKKIYKLLGHNISSYISETGCLFQHADAGMCLSSGCLLRS

SEQ ID NO: 28 - protein, 820 aa, herpes simplex virus 7
MSLSSLFNGKYDTKFLLNMSSAAKVELIVEKVAALADACLETPLPTDWFRNILDPELEFNSNFEEIHSIGDEEFAQPLPFLPFRVLLITGTAGAGKTSSIQTLAANSDCLITATTSIAAQNLSGLLNRTKSAQVKTIFKTFGFNSSHVSMNERISCSVTTLDSIADQQKHDLSTYWNVIADIAERALNAANGKTKVIPDLCESSVIVIDEAGVILRHILHTVVFFYWFYNGLHKTQLYKNRVIPCIVCVGSPTQSGALISSFNPLTQNKDVKKGFDILSALICDDILSNYCKISENWVIFVNNKRCTDVEFGEFLKHIEFGLPLKPELIEYVDRFVRPATYIRNPTNEIGMTRLFLSHYEVKSYFKVLHEQVELTNKDNLFTFPVYFIIQNKAFEDYKNEISNFTLEIEPWFKTNLHRLNTYSQFADQDLSKTIQIEEIVLDDGSVEETLITCHLKHIKHSSIGVTSRTKSSTVGFSGTYEKFVELLQSDLFIEKTACEYSVHAYSFLTGLMYGGMYSFCLSEFTTSEVMTEIRKIKLPNIDFLQTMTAEVSLQTFDESDEYYDLHIAPTDEEMLASDPCPDPFFLKYKQLPLTNVLTFEEISYLYTVFKEIFISRFAILQRHSKEMFGKSNLITYNRNNVSSKRCGEICSHVKSFYGMLTYAVPANNYTLEGYTYDNVIFLGTDKMLPPIIYKRGLPKIVIKDEMGFISILDNNVSKLTDTVNGNSFHICTTIDYAIVSKVAMTVTKSQGLSIQRVALDFGNDPKNLKLSSIYVGMSRVVDPNNLIMNLNPLRLNYENDNIIASHIVKALKNKDTMLIF

SEQ ID NO: 29 - protein, 166 aa, herpes simplex virus 7
SNRALSNKYKKGKIRIFHNLLSTISIKIEKIYRLDVIQKFIVLTNHCLFSDIDTEFDIYEFFERLNFNLTSFAVLTVHVDRGLYKQMLSSFPRPGGYDAISFIRELVVFAVKLAEVNRYFFSNGKIQKRFMRNNFRQISLRLFKNDLSYEGFCWLHSGNQFSCQKA

SEQ ID NO: 30 - protein, 233 aa, herpes simplex virus 7
MIAEDREYGTFESVTQAYQQIISHTLQLRRYEFETGCMIMFSANSGKCEMLSNGWISMISWTSETDTAGSLTLDICTEGGQCKTYSARGHILCSKNITSISQKNEGKEKVLTICHDNGKLHLTYITVLKSGLDCDIKDQKLEKLFEKEHAERKKQDDDYKKKALKQKDKRRSEQKILEDCDKKDEKKRMDDTEKRKLQEDRRNEKQDLKKRVDDTEKRKLEDDRRNEKQDLEG

SEQ ID NO: 31 - protein, 82 aa, herpes simplex virus 7
CLRFLHKHVFLDASKEKRMKVHHEKRHAEEQANEEVASSSQLSSRIPEGALSPTISIDLQEYQEFEDFDKRICGQVGGVLGL

SEQ ID NO: 32 - protein, 210 aa, herpes simplex virus 7
GKNQDAVCKKVQSDESFCINKPLEQFREKLIKITHEAVQQSLLQSRGKNEDNKKDVTQNVKFADENMNFAGGSKCTSKTKHIEDQQIQFGAQNRFVPICEIKPFIDVNLLKSNVRGRRSTRGRRNSNSARFSASTFEQPIETSEMLTVSTRSRGRSRGRPRGRGRSRNMSMRQTPREVEDMLPIVLDSDSDTETLRRNEDLLASSILQTL

SEQ ID NO: 33 - protein, 167 aa, herpes simplex virus 7
MVSDGCPTINIGEVAPLLSIVLSVCLATPTITNQSEILTPFQTQYKASLKILSSRVLKLCLKKMYTLEYEKRVSRPKLTYWIILAILFVFLIITGSVLIVIETLSIQRTTLNAQNDKTSTVVPELTSNSPGLFSYKMSLFKKKVCNSVNMNIFSCRSNNCDKFFCKF

SEQ ID NO: 34 - protein, 427 aa, herpes simplex virus 7
MSSHPFRQERPQPHNPLTFKPVKTTGTAVAFSAGFMGSHPFRQERPQPHNPLTFKPVKTTGTAVVFSAGFMSSHPFRQERPQPHNPLTFKPVKTTGTAVAFSAGFMGSHPFRQERPQPHNPLTFKPVKTTGTAVVFSAGFMSSHPFRQERPQPHNPLTFKPVKTTGTAVAFSAGFMSSHPFRQERPQPHNPLTFKPVKTTGTAVAFSAGFMGSHPFRQERPQPHNPLTFKPVKTTGTAVVFSAGFMSSHPFRQERPQPHNPLTFKPVKTTGTAVAFSAGFMGSHPFRQERPQPHNPLTFKPVKTTGTAVAFSAGFMGSHPFRQERPEPHNPLTFKPVKTTGTAVAFSAGFMGSHPFRQERPRPHNPLTFKPVKTTGTAVAFSAGFMGSHPFRQETPRPHNPLTFKPVKTTGTAVDFSAGFMGSHPFR

SEQ ID NO: 35 - protein, 940 aa, herpes simplex virus 7
MESGDSFGNNHQVSSNSDAFQFRQYSTTVDTFAYSSMDPSNCMLNEQTHLETVLVYPVYNMSSQQTVERNLYANNIGNGNVLSYCRQDSLQGNQGTYFPTYQGFHSNTPHNFSIENFNFGTNVIRPIPFRNEGVDASTSKDYGFKPCITTMQIQFSQPSAFQTYSLMNGNFSENGYGYNTKIGENCAMSYVEQESVDSKYPNKEVSISYQRNEHYDENLPTRELNTDFPQYNQSSVLQHTFANVQSIISQQSPYQLIGKENSFNNYLETANVDSDCQSNGGPKIGLDTDQSVFSDEVTGACVENVHFPMNPKNEYVNNISLDVQTEFPVTENPLVGESQATKNKDVDSNAEVNNHSKYRLLKRNITPTMGNIKHLNFSCKISTEEERKTFFNRLSELLKIRDDIKNTKISSKVDFIQSEASTSLDICKNTFNNNSDSSDVDTDILADNPLVICENELICDNNEENIKFPPNVEKEAVPMQTVKRSFPEICPEHFKKRRFINGDVIYEDLNSVYKVMPASATYDDVRFGEVDYQTSSAQTKISNHQLALLPTNYQHMIGQETDISSRDYHNDSAQIIYNCSFQRQGKRLLADIPYRPWLKENVPTGEYGKRFVKTVPRPASVFIFGRCRKKMLRESVKSFMHLSKLQYTKESLEAYVLRNCNKFLDLSWPIRHKIYIMPDVSRNYNIEEVKNLFPVPEGWMVTLGFVGTEEPVTKIYNIAVLLCENGWVMIHKNDKVEPELYLAASNLNELIEDGLARCDCIYEKRSVPYGIVMEGKLRQFMDNFGSLQSVLAYRKYLHGFLWAFNGTPGRLADRVFHTCVPGVHNALPLDAVIKHENNPLYFIGYVTTFKQQNDFNANVFIAVDGNLSIYGYHLISQKTWFLAKTFSTFLKMGTRKMYYDYEIPLKIHLGDSADSFLSCFKNAPCLLLKPEVLRKQFPKP

SEQ ID NO: 36 - protein, 169 aa, herpes simplex virus 7; identical to SEQ ID NO: 2

SEQ ID NO: 37 - protein, 400 aa, herpes simplex virus 7; identical to SEQ ID NO: 3

SEQ ID NO: 38 - protein, 79 aa, herpes simplex virus 7; identical to SEQ ID NO: 4

SEQ ID NO: 39 - protein, 162 aa, herpes simplex virus 7; identical to SEQ ID NO: 5

SEQ ID NO: 40 - protein, 262 aa, herpes simplex virus 7; identical to SEQ ID NO: 6

SEQ ID NO: 41 - DNA, 459 bp, herpes simplex virus 7
  CDS (1)..(459)
cctactgggagcgccgccaaatctgttttgccccgcccctgcgcgcgcgggaactgtcggcgccgcgctgctgctagcccgccttccagagctccctccctccgtctgcctcctcacccttgccactcacccttccatctcttctatcacagactctgtgttacaccacctatgactgctgcaaccacagaacattttgctctccgcgcggcactcaatcgttactggtggctgcttctgggacgacacaagctcagtttggtatgcaactacgtcacagctcatcgccaacagttactgccgctgccgtggcccgaacaggaatttctccaacttgacccggccccctactccaatctccgcaaccgtgtcgctcaccatctccatcgcggctggccagcggcacacaacacatgtaagctaccgtacatctctttcacaaacccagggctcacatag

SEQ ID NO: 42 - protein, 152 aa, herpes simplex virus 7
PTGSAAKSVLPRPCARGNCRRRAAASPPSRAPSLRLPPHPCHSPFHLFYHRLCVTPPMTAATTEHFALRAALNRYWWLLLGRHKLSLVCNYVTAHRQQLLPLPWPEQEFLQLDPAPYSNLRNRVAHHLHRGWPAAHNTCKLPYISFTNPGLT

SEQ ID NO: 43 - DNA, 1665 bp, herpes simplex virus 7
  CDS (1)..(1665)
atgacacagttaagtctattttatcaatttccaatccaaccaattttcgaagggcatgtcagaaatactctaatttgtaccgaggaagatatgcaacaactccaaaacttgggaattcgaaaacttcgaaaagaaaaagaagaaattcaaaaaaacaagattttaaaaaacttgttaaaaactgaacttgatgttttgcaagcacatgtacagacagaatgccagaaattaaatacaaatttaagagacattgaaaatgcattgcttttagaaaatcaaaaaataattccttctagtgaaacacattctgtcttggaagagtctctccaggctaaaactgtcacgcaagtcacaattacacaaattgatcctgctattcatttcacggaaaatttccgacctgagatgataaaaactttttataataatactcagatgtggagctatacgtttggagcttggttttacaaattaaagcgagctttctttaccgattctaaattaaaaagaatgctaaagttaacatatgttgattctctctctattacacaggaattgctgtctatttcaattaatgcattggaacaaattactatttatcctatgcatgataatttagtgtccgatttagaagctggtttgtgtctactgactgctttttttgcatcgtatcctggaactttcttaaccgaaaatattaaattcgtggatgtcattcaaaatttgtctcaaatttttagatatctaaacaccgaaattttagctacgaaaaacgcgtcaccacaggatttttattttggattcaatgatccagacaaaatgaaatattttattccgttgtgtaaagggaggcattatgcaataaatacattcagtaatcatatcttaattaaaatttttataaaaaaaggtgtgataaagcaagttcccggagatcaaatgtcgaaaggacatgttgtaatagaatcgaagttgacaggcacgttaacagatgataaattattatattggactcaaattttattgcaaccgaaattgggaaaagaggtgccgatatttgtccatcagcagcagtatttgcgttctggaattgttgccatagaatccttatatttactttggcaaattctaaactcagaaagcatttttggaaagagaactgggaaattttatctaacaacaattttcccccatgtaaatgcagaagatgttacagaaacagaattttcttctgtcaatatccagaattttgagtttctcatgaaaaactatgtcgtccccacatatttagccaataatgaaagtactatttccactttatttccggggttaatcagcatcgtagttaacgaaagtgttcgtttaggctgggatcataatcaaaatactttaacacaaactaatgctttgcatagccaaacaaaagacaatccgtttgttgaatatatccgttcacaattagaagaaacggcagaacttgcggtactcgagaaacatgataaaattctttttcattttgaaaatggcttgaatgtgacactctcattagcacttccacgacataggttgttcgctatggcatcctcattatttaatgtggctgatttgtatgatttcttgtattttttggtattaggttttattccagtagcaactgttatttga

SEQ ID NO: 44 - protein, 554 aa, herpes simplex virus 7
MTQLSLFYQFPIQPIFEGHVRNTLICTEEDMQQLQNLGIRKLRKEKEEIQKNKILKNLLKTELDVLQAHVQTECQKLNTNLRDIENALLLENQKIIPSSETHSVLEESLQAKTVTQVTITQIDPAIHFTENFRPEMIKTFYNNTQMWSYTFGAWFYKLKRAFFTDSKLKRMLKLTYVDSLSITQELLSISINALEQITIYPMHDNLVSDLEAGLCLLTAFFASYPGTFLTENIKFVDVIQNLSQIFRYLNTEILATKNASPQDFYFGFNDPDKMKYFIPLCKGRHYAINTFSNHILIKIFIKKGVIKQVPGDQMSKGHVVIESKLTGTLTDDKLLYWTQILLQPKLGKEVPIFVHQQQYLRSGIVAIESLYLLWQILNSESIFGKRTGKFYLTTIFPHVNAEDVTETEFSSVNIQNFEFLMKNYVVPTYLANNESTISTLFPGLISIVVNESVRLGWDHNQNTLTQTNALHSQTKDNPFVEYIRSQLEETAELAVLEKHDKILFHFENGLNVTLSLALPRHRLFAMASSLFNVADLYDFLYFLVLGFIPVATVI

SEQ ID NO: 45 - DNA, 1044 bp, herpes simplex virus 7
  CDS (1)..(1044)
atgacagcaaaacaaatttttccagtttggaaagactgtacactttacgttaacaatgagacagcaactgtgcatgaaatcttgaattccgatttaagtgaactgttacagttaaagacggaatttgtatctatgacagacctatgtgtttacattactggatgtataaatcagaatatttccagcatcacgatatattggcatgcttacagtgaagtaatttatgctttaactggaattatacactgtgaaaagatttctattgaatgtggaattaaatccacggacaataacattttgtatgaaaagcccaaactgtttttacttcgagaaaatttagcaccaactgaattaaggtggaaatctttaataaaaacaaagactataaaaagtgctctgtctccaaatcaaaatgagatttttcccaaaatagcacacaagccgtcaatccttttagagattgaagaagcaccccgatttaaggaaatggtgtcatgtatttggaagttagttgccgaagaggcgaccataacctcaaaaagcgagaatgatattgtcaaaacatgcaaaaagcttgctgaatcacaaagatatactttgacaaatggtactgtgttgcaaaattttatattagtccatgcctgcttatttaagcttggagctgttaatttttgggaggaaatgaatggaaaattacgtcaacggccagaactaatgtcaaaatcattcactggccatgaggaatgtttctataattgttattatttatgcactttgttaaattccatttatagttacaaaactttattgccagaaattgtagacaataccagatccattcatgtagtagtgaaagcatattattcagagcacatagatgtttcttacaaaattctttcgtactcaacaaacatgatgaacttattctctcagtatttaaattttacagatttattgccatatataaataagcacattaaaattgatgtttcagcatctaagcaagatatgattaaattcttaaatgcctgtttgggactttag

SEQ ID NO: 46 - protein, 347 aa, herpes simplex virus 7
MTAKQIFPVWKDCTLYVNNETATVHEILNSDLSELLQLKTEFVSMTDLCVYITGCINQNISSITIYWHAYSEVIYALTGIIHCEKISIECGIKSTDNNILYEKPKLFLLRENLAPTELRWKSLIKTKTIKSALSPNQNEIFPKIAHKPSILLEIEEAPRFKEMVSCIWKLVAEEATITSKSENDIVKTCKKLAESQRYTLTNGTVLQNFILVHACLFKLGAVNFWEEMNGKLRQRPELMSKSFTGHEECFYNCYYLCTLLNSIYSYKTLLPEIVDNTRSIHVVVKAYYSEHIDVSYKILSYSTNMMNLFSQYLNFTDLLPYINKHIKIDVSASKQDMIKFLNACLGL

SEQ ID NO: 47 - DNA, 636 bp, herpes simplex virus 7
  CDS (1)..(636)
atgaacaaaaaaaagatggacttgcctaaatgtcagtcaatcacagttgcttgtgaaggagaatgttcgcaaatgtacaatttgcataatcctctgacatttgaaatgggtttgggaaacatctttatatgtgttcggtgttttaagatacatttttgcaatatgctagaagactgcaacctgataaatactcatgaaggatgcgtgtgttcaaaaaccgggcttttttataacggatggatgccagcctattcacatacctgtatggaacctactgaagagccaaatatggagaccgttaatgtagttgtagtgctgttatcatacgtttacagttttttaatacaaaataaagccaggtattcaaacattattcgcgacattataaaagatggaaagtttatagaacaagtagaaaatgctgttttttgtacatttaataaggtgtttaagaactccaccttgaataagttacctcttactactgtcagtcaactttttgttcagttaataattggaggccacgcggaaggcactatttacgataataatgtcattcgtgttagtagaagaaagagggaggataacatacttaaaaaaatgaggattgaatatggaaatgcacttgctctgtga

SEQ ID NO: 48 - protein, 211 aa, herpes simplex virus 7
MNKKKMDLPKCQSITVACEGECSQMYNLHNPLTFEMGLGNIFICVRCFKIHFCNMLEDCNLINTHEGCVCSKTGLFYNGWMPAYSHTCMEPTEEPNMETVNVVVVLLSYVYSFLIQNKARYSNIIRDIIKDGKFIEQVENAVFCTFNKVFKNSTLNKLPLTTVSQLFVQLIIGGHAEGTIYDNNVIRVSRRKREDNILKKMRIEYGNALAL

SEQ ID NO: 49 - DNA, 993 bp, herpes simplex virus 7
  CDS (1)..(993)
atgaatttttcttcgattggcaatttgggatgtcttaggagttttttacaaaatgagtgtaattggttttcggtgtgtaaaaaaaagttgtaccacgaatatcgttgtgtggcaacatcttctcctgttttcgctgttgataaatttaaagattgcttgcactgtaatataattattttaaaaaagaatttggattttgtttttagcttggccataaacggaatacatgccggacagtttgcaacaaattccattaaactaaaaaaaattataataacaaacgatttggtgtactacatattagaattgggatctttaacggtaacggatttacatttcattccaaaatacaatagtgaacatgtgctgaatgtgcgacctattacgccaaatctaatttatgatacttgttcaattgttagttatgacgaagctaaacttttaactgttaaaggacctggagaaaataaattaattcctttgggttgtggttcttggtgtctcaacaacatgggacgttattatgtgtacacttttgtcctggtgtacgatttatatctggcttgctttgaaaaaaacactttgccatcattatctaaagtagtttttgatatgatttcctgcaataataaacattgtgttttttgtaaggatcatagtaaacacgtagaacaaactggcaaaaccgttggatgcactgataatcaagaaacatgtttttgttacaccccatgcaagaaaaaaatggctaagatttccaaccaagatctgtcttcattattatgtgatcaagagctcgatttacttgatctaatttaccctgaaaagcccactagtctttcaactgatataaatgcttacgtacatggacataagaatcaagaaccagtcgttttaaggaatacaaactggatattaattcgtcttgacccagcaattagcagattaatactcctttcctgtccagtctgtaaacgcatagtaagtaggtaa

SEQ ID NO: 50 - protein, 330 aa, herpes simplex virus 7
MNFSSIGNLGCLRSFLQNECNWFSVCKKKLYHEYRCVATSSPVFAVDKFKDCLHCNIIILKKNLDFVFSLAINGIHAGQFATNSIKLKKIIITNDLVYYILELGSLTVTDLHFIPKYNSEHVLNVRPITPNLIYDTCSIVSYDEAKLLTVKGPGENKLIPLGCGSWCLNNMGRYYVYTFVLVYDLYLACFEKNTLPSLSKVVFDMISCNNKHCVFCKDHSKHVEQTGKTVGCTDNQETCFCYTPCKKKMAKISNQDLSSLLCDQELDLLDLIYPEKPTSLSTDINAYVHGHKNQEPVVLRNTNWILIRLDPAISRLILLSCPVCKRIVSR

SEQ ID NO: 51 - DNA, 345 bp, herpes simplex virus 7
  CDS (1)..(345)
atgtcactgcatgaattaataaaacaaactatgtccaaaaatttagaaaaaaaacattatgagttgttaaaattaaaacttggtgaagatcatcctcttagcgttcgacagcaaattcacgctctcaatcaaaatcttgtatcagaaaatctcgaacagtcccagataattacttctttgacaaaaatgttaaaggatcaaaagctgcagctgaaagcgcaaaggaaaaatgctgctcagctagaatgtgtagatttggatgacattttggatacggcagcggaagtgaaatccgtcaccgacaatataaaagaaactttactggccggattagaatcagactaa

SEQ ID NO: 52 - protein, 114 aa, herpes simplex virus 7
MSLHELIKQTMSKNLEKKHYELLKLKLGEDHPLSVRQQIHALNQNLVSENLEQSQIITSLTKMLKDQKLQLKAQRKNAAQLECVDLDDILDTAAEVKSVTDNIKETLLAGLESD

SEQ ID NO: 53 - DNA, 222 bp, herpes simplex virus 7
  CDS (1)..(222)
atgggctcaaagtgctgtaagacaatacatggcggcatcttcagcaaggccgaagacaccttagtagactataaaggaaaatatattaatcttgaaaaagaattttctgctttaagtgatactgaatctgaagaagagttgcaactagagaagccacttctaaataaacaagattctagcgtttcgttaacccagaagaaacttgaaaatcaatccaaataa

SEQ ID NO: 54 - protein, 73 aa, herpes simplex virus 7
MGSKCCKTIHGGIFSKAEDTLVDYKGKYINLEKEFSALSDTESEEELQLEKPLLNKQDSSVSLTQKKLENQSK

SEQ ID NO: 55 - DNA, 1980 bp, herpes simplex virus 7
  CDS (1)..(1980)
atgcagatgcggggatgtgtttgtcatctgggtgtctattgcgttcataacgattggaaaaataaacaatatagagtaccaatttatcaatgcctgttttttaatgctgagactcactccttgcatacttttttggttattggaaatgagatttctgaaaatctccttgataagatttccatttcaaaagaaaaaatctttatgtgggatttgaatgaacaaataatgagtataactcaaaagacagagtcaatctgtgaactgatgtttggcaacaaacaaataattcaaaaactatccagaacatttattttcttaacaattattttaaattctaatatgtatgaaataatagatgtctgcatagacagtaatgcggttttgtacatgccagacttaagaccaatgataataagatgtgttggaaactattcgaaaatatcttctgaactattgtcagattcagactgcacacaggcgacaaagaaaatgcgatttgattatcacgtcacaaacttttgtttctcattaaatgtcaatggtaaaaaagtactgttttctagtacagagtcttcagaaagtattttagaaaaattgcttgagtttttcacaatacaaacatataaattggcagaagaacaattcttaatggtgacacctaaaaacttttttaccgtcttatttgatgaggacatgtgtctacttttgctgcaaacagttgttagttttttgtatgacaatctatttcgaaataagttagttgtgaaacaagttcatgattacattggtccagatttgtggccgcaaggacatgagagggcagtttattttgtagggtttcctaatatgtggtttttatcgatttacgatttggacaacaagataccttgtattaaaaatatttgcaatagaattttactttactgtggcctgccagatagtctaggaccagatggttgccagagtgttccaagtacgcagtgtgtggatgaattcgaagaccttcccaatttgggagcattacaatatttgaaatataatagtttggttgttacaatggaaacagtagaaaattctgagaatgtgtattatttttttggagagcaggatctgtttattgtcaaattggtagacattattcaatctttgttggaactatatgttcctaaaagttttctcccagattttagcgatgcttatataaaaagtgaaatcttattgaaatttatatctcgacttcacaaaaaatctaacaacattttttgtaagatcgtaaaaaaaatcacagagtttttgagatgttttttaaacgcgtgtcgattaatggatcttaattggatgtttattagaaacatgcatattgtgtattttataggtccaaaaaaggatccttctgtagtacttcctctgttaaaaacgtctgtggaaagttgttggaaaaaaattctcaattcttcaagaactccagtagtgaacataaattacatccctggttacaatttcctacacagctcatgtagctttttgacaagcggagacatcaatagtgaagattctcattggactatcacagctagcaagtgtttatataattgtttaggggcaagtcagattacagtagattttaaaaatatttacacaaatttccagcagatggttagcgtttttctaagtcacagatacgaaaataaatattggatcgaatattttgagcccaacaactattttctagagacacacgaaggtttactagactgtaatagatatacagctgtctggacaacagaaaacaaactaataagacaatctgttggttatccattaacggataaaatagattttattcattacatccaggttgtgatagaaattttcaaaaagtggctcttaacaaaatatagtcaacaagagtatgcagaaactgttagattaggaagtaagatcatctctgatcatttacatttgtttaatgtaaactag

SEQ ID NO: 56 - protein, 659 aa, herpes simplex virus 7
MQMRGCVCHLGVYCVHNDWKNKQYRVPIYQCLFFNAETHSLHTFLVIGNEISENLLDKISISKEKIFMWDLNEQIMSITQKTESICELMFGNKQIIQKLSRTFIFLTIILNSNMYEIIDVCIDSNAVLYMPDLRPMIIRCVGNYSKISSELLSDSDCTQATKKMRFDYHVTNFCFSLNVNGKKVLFSSTESSESILEKLLEFFTIQTYKLAEEQFLMVTPKNFFTVLFDEDMCLLLLQTVVSFLYDNLFRNKLVVKQVHDYIGPDLWPQGHERAVYFVGFPNMWFLSIYDLDNKIPCIKNICNRILLYCGLPDSLGPDGCQSVPSTQCVDEFEDLPNLGALQYLKYNSLVVTMETVENSENVYYFFGEQDLFIVKLVDIIQSLLELYVPKSFLPDFSDAYIKSEILLKFISRLHKKSNNIFCKIVKKITEFLRCFLNACRLMDLNWMFIRNMHIVYFIGPKKDPSVVLPLLKTSVESCWKKILNSSRTPVVNINYIPGYNFLHSSCSFLTSGDINSEDSHWTITASKCLYNCLGASQITVDFKNIYTNFQQMVSVFLSHRYENKYWIEYFEPNNYFLETHEGLLDCNRYTAVWTTENKLIRQSVGYPLTDKIDFIHYIQVVIEIFKKWLLTKYSQQEYAETVRLGSKIISDHLHLFNVN

SEQ ID NO: 57 - DNA, 459 bp, herpes simplex virus 7; identical to SEQ ID NO: 41
  CDS (1)..(459)

SEQ ID NO: 58 - protein, 152 aa, herpes simplex virus 7; identical to SEQ ID NO: 42

SEQ ID NO: 59 - DNA, 144861 bp, herpes simplex virus 7
  CDS (140638)..(140886)
  CDS (140117)..(140413)
  CDS (137445)..(138524)
  CDS (136130)..(137284)
  CDS (134480)..(136108)
  CDS (131858)..(134455)
  CDS (130600)..(131688)
  CDS (126613)..(128880)
  CDS (122298)..(122618)
  CDS (121026)..(121292)
  CDS (119262)..(120149)
  CDS (117940)..(118917)
  CDS (115368)..(116660)
  CDS (114444)..(114959)
  CDS (114090)..(114338)
  CDS (112964)..(113926)
  CDS (110911)..(112005)
  CDS (108378)..(110798)
  CDS (107515)..(108375)
  CDS (98235)..(98507)
  CDS (96094)..(96870)
  CDS (95743)..(96057)
  CDS (90461)..(93499)
  CDS (85865)..(88030)
  CDS (82467)..(85862)
  CDS (80510)..(82090)
  CDS (77776)..(80361)
  CDS (75964)..(77103)
  CDS (74283)..(75224)
  CDS (71973)..(74045)
  CDS (67913)..(68677)
  CDS (64992)..(66359)
  CDS (63661)..(64944)
  CDS (62285)..(63577)
  CDS (61351)..(62232)
  CDS (57311)..(61348)
  CDS (43186)..(44226)
  CDS (36273)..(38195)
  CDS (28914)..(29678)
  CDS (28084)..(28824)
  CDS (26819)..(27751)
  CDS (25949)..(26791)
  CDS (22154)..(25771)
  CDS (16194)..(19442)
  CDS (15811)..(16086)
  CDS (8283)..(8555)
  CDS (6170)..(6487)
  CDS (5863)..(6111)
  CDS (1591)..(1839)
  CDS (1070)..(1366)
tgtttttcactgagtgctgcgcgcggctcgcagaaaaagtgccttgaaggcattacaagacattggctgccagtgggggcggggttagggttagggttagggttagggttagggttagggttagggttagggttagggttagggttagggttagggttagggttagggttagggttagggtcagggtcagggttagggttagggctagggttcgggccgcagccctagggttagggttagggttagggttagggccgcagccctagagttagggttagggttagggccgcagccctagggttagggttagggccgcagccctagggttagggttagggttagggttcgggccgcagccctagggttagggttagggccgcagccctagggttagggttagggccgcagccctagggttagggttagggttagggttagggttcgggccgcagccctagggttagggttagggccgcagccctagggttagggttagggttagggctagggttagggccgcagccctagggttagggctaggattaggattagggttagggttagggctagggttagggccgcagcctagggttagggtcagggtcatggttagggttagggttagggttaaacttagagctacggttagggttaggcttagggttaggcctagggtcagagttagagctaaggttagagctagggttagggctagggttagggctaagggctaggattggggttacggttacggactaggattagagttgtagggttactgttacgattagggtgagacttagacttcggtttgggttgagttttgaatttacggctgcgtgtctcactgtgcccgacaggttatgcttagaggtgtagttcattgtaggtaacgtctacaacctcgcttgattgtaggactacatttgcttacgatcgtatctttcctgcagcttacagctgtgcgttgccgtaattaaagtcgtgtgtgacctcagtttaagcttgctgcggctcgatcccggaaaaaccttgtagcgacgtttggcagtgtttcaggggatttagcatgggatttgtggtcagggttacggcaggtttccaatggaaagtcaggtgtatcattgccttatttttagttttttttccaggtgataaggccgttttgtttataaagtgtggtctggttccacagcgtggttttcggtgttattgttctgcatctatcggagtttttagtatgccaccgctaactacggtggcacagacaacaatatggactgagacactttacctcgtcagccgcgtaaggaaaacacagaaagacgaaacggaccactgccacaactgtctgtatcctgtttaatttgccttcatttacagagaattttagtcactcgcgactttttgggacatgattattgttaaaaacatattcttagaaacttatgtactatacaggatcacgctagcctcatggctaacgctaaagagcattcatgcctagagggcacgtttagaaaacgaaagtaagtccaagtcacgtggttctctggcaggcaaatctcataatgtctcacgagaaagggcatgtctgcctcccgggcacactttgaaaacgaaaggaatcttaatcacgtgattgtgcttgagccagcaagaacagcaatgttttcagcgccaaacgctgacagtcatttacagcgtggccttcttgcctacactttcggtactccctctagtggcaacgaggaaggtgatttttttttcccagttttgcacacggacttatttttgggtacagtttgttctagagtatgtggattgttttttttttgacacgctgtttcgcgataacactcttgtactttttttcttttttttttaatctttttaattttgttctatctaggagattggtagtgtgcacacaaaggccaggcctctcccgctctatgccggccgggtgctgcgtatgtccagtgaccttttagcgcccgcgctccgtttttccagagtcctttcatagacgaggccaatctgcacattttggcgctctctggccagaatcctagaatggcacccctgccagtaactatcacccacacggtttcggcccctggcgttacgggtggcactgcgcgattcgtctcttttgcatcgtacgtgagcacggcacacaacagccacagcccaagtgggtggtccggatgtaggtgctgcagcagtttgcgtcgtgcgtttggccacaatcgatactgctgccgtgcgaccgtcagtgtgaagcgtgccgccccagcgacggtgtggggatcgtggtctgtataccacagttggcagctgacgccggtgtgagtctgacacagtccggccacggtgagtaggtcgtggacatcggctgcctgggtaattacgtcaaacaggtgaatggccgttgccgaacctactcgacggtctggcaaggaaacatcatcttcataaacctcggattctcgctgcagccctcgtcgcgcgaattcggtcacactgctggccaggcggcacagtcgcgccgttctcatgtgatgcacatacattgctccgtccctggctatgaggaggacgcgtaacgagttcaggtctgaaggcgcggctctgttgcgtacgtatccgacgggctgcaacttttctccgcgtccgcagcacacgtacatatgcgtgtcgagggctgccgggatgtagataacaacaaaaaacacaacagtcacacgtgaagaaagagtgcttaatacattaataaaaagttaatcgggtaagacaattgcgataacaatgtgtcacactgcttacactcaccgcagtcccgcaccgtgcgagctgtcacgtgtgttgcaggccatccccagcggtgactccaaacggtttgtgctctggcgtctcgatagggatcgtggtgaagttccaggctccagttaggcggccatggcaatgctacgagttctcctctgtgcctgaaggcatatccgtacacttttcgcggagaccctcgactcaaagacagccacgcgtaaatgttgaggaaggaccggtgggataaagcttcgctccatgttttagctctgggtttaggtctgcctctacgcccttggtgactgtcgctcgattggagtctcttgggactgggctctccttcgagtggaggggaagtgggagatgaggaatgtccccggcgtcttggctggagctgaacagcgcggagcatttctgcactcattggctttgtgttgttttctgttttttttttggttgtggttgtatttggtgtgtctctaaggtctacttaaaggaactgtctctacagtctctttcgttgttgtggacccacgagtactgcacattggctgtgaatggaaagaaaaagaagatagactattgccagttttggttgtaaccatttttaggtggtggtaagcgtgtaggggattatgagttagtgagatctctgtgtttacctcaccaagtttgtgtgtgtgtgtatgtgtgtaagatccacgggatccggttaacatgcaaggtatgatacaaggaagagttagaacggggataagaacgggaatagaggtgcactttttatagcggaacccgtattatttggttggtacatctgaagttcacatctgttcttttacgcgagaccttggcgagctttcagacaccgcgctgacgtcgcagctgctacgcctgaggctgggttttttttttctttgtgtctttcaggatagctgtcacggacaagagacgcgcttccagcaggtaactgggaaggcgcggtattcttattgttgtcgtggcattatgcgtcgagatcgctcgagttttgtgagactgggtggcggcggcgaggacggctgggctcctggcttctggcggcgtttctcggagactgaggggaaaggtcggaattgccgacgatacgcgggtgtgtttttttgaggtgttgagttttttattctcattttgctttttgcttgtgctttgtttcatctcttggtcttctgtctcatcctgttctccgcgcgtatctagacagttcctccacacaggttcttgctgtaaacatgaccaagacgtcaagtctgcggtcggccgcgacagtagtaaaagactaccggtgaccaggaatagcagcgcgtcgtccgccacgcgccacagaaagttttgtcggacatctatggcggtgaccagacatgttcgggtcaccgccaggtgaatgtgcggcatctttactaggtagccgatggacagccatgacccgcggccaccgcagactgcgtccattacatgtggcgttgttttaacggacgtgcgagtgttttggcagggtgcttcttggaatgagcggcccgtcagtatcatgtccaggacgtagccgttcacggggtggattagcgaacacggagttcctctgtggatttttagcagcgagtataacgcgtccagaccgtgcgtggcactcacggcgagtgtttgcgtgagggtggcggacgctggcgggctcgccacccacatgttgggcagaggaacgtgcttccatctgggtgccgcatataaaggttcgcagtggcgaaggcctagcctggcgaacaacgatacagagtgggccacgagatacaatcggccgcggtacacgtcgtggcaatagatgctgccgtccggtccttgaagcagcactaggatcggggaggttcctgtgagccagctgcagataacagtatggtagtcaccccggtcatgactgtgatgcacatcatcaccaataggatgaggctcgtcactggagaatgatctggtaagggtgatggagccgagcggaagcagcttgactttagcattggggaagtaaggacgggggtcgaaacctgcgatagagcaaagacgttatcggcaaagcgacaggaaaggacaatgatgggaggttttaatgtcattgcgcgagcttgtgcttgtctctatgtgagccctgggtttgtgaaagagatgtacggtagcttacatgtgttgtgtgccgctggccagccgcgatggagatggtgagcgacacggttgcggagattggagtagggggccgggtcaagttggagaaattcctgttcgggccacggcagcggcagtaactgttggcgatgagctgtgacgtagttgcataccaaactgagcttgtgtcgtcccagaagcagccaccagtaacgattgagtgccgcgcggagagcaaaatgttctgtggttgcagcagtcataggtggtgtaacacagagtctgtgatagaagagatggaagggtgagtggcaagggtgaggaggcagacggagggagggagctctggaaggcgggctagcagcagcgcggcgccgacagttcccgcgcgcgcaggggcggggcaaaacagatttggcggcgctcccagtaggtcacggaaaggcagggcgcacagccaagagagcgcggagtgcagaggcaatgtgggcgtggaagaggaagggttgagaaggcagggcatggagaacaggaggagggcgggacggagggtggggctcggagcggtaaggaaccaggagtcagggcagatatggataggatctagaacagatgacttggagctagtgttagggtgacagtgagagctagggttagggttggggttaggcttagagctagggttagggttagggctggggttaggcttagagctagggttagggttagggttagggttagctccccccctttttttaccccccgggggttatttaggatttgaaatacgaaacgggggggaataagcctgcacataaagacgctgcaaaaaaaatctcttcgcagataatggtgcaactgcattatataattttcgcatcactcataaagatatgtaccaatacggtcccacttgaaaaagcacgcacggcaataactctagaagatataatcgaaaacttaataaatgaaaacatgcacaacgcaagctctactagatatattggtctaagttccgaggaaagacaaagcttgttagaatacacaagatgtacatcgttttcctgcgaatgtgaatggccagacgaagcacagtaagtaaaaatggttacactgatttctacaatatgacgactttgaagagctttttaagtaaatttctcacaccttacttttaattcttctaagggttatattattagaaacaacactctgcattccactaaaagagaactcattgggagtgcgcggattaagagaaaaaattatgagtaaagggctgtctgaagtcttgtcagtaactacaggcttacactattctctacttaatggaggattcggaagtaaacaaaacagtttgttgtatgtgaaaagaatgaacaccgcaaacattttgacgagcctggttttgttccctgctcgccaccgttgggaaagacgtgagcaatacacccagtcgtctgctcaatggtaagcaaaaaaaggtactatctatagttatttttttctccaagaatttgaatgtaaagtacccgcttattagtgaattacagatacgcgcagattttaaaaagatgcgtagctacagcggaatagcctttcggacacaaatatcactggcaatcgtccgaaaagacaacaagggctacgaatgggaaacttgcatgcaattttcacaatggaaagaagaagattttaacatacctaaagtgaacatgacttcagaaaaaccattgtatgacgcttgttgcccggataagaacaaaagtcgagaaaacacgacatacgcgtggcgatggtcagaacatccctggacagagacaaccatcgaaccctggagagacatagacattattagacagatacccacggacgaaaggtgcttaacaaacactacagtgtaagtactgtcgcacaaaactgctcatattaacaagcacactaaaaaagaggaaaaccgcacatacatgcaatcaacaaaatgacaaaaaggttgagttgacaatatttttttttttagattccagtctacatatggacaaatttggtgctcgcctaaaaacgatacaactgcacgaaactacgtcaccaccgtaatgtaagaaaagcaagtgtcttttattactcgaaatttaaaaactggagagaataagcaaataaattgtgtttcgcagtctttttccaatagcactactagaaatagaacgcttattcgacactattggacaaaagactgtacaagacatgtttccacatccgcaccgacagtcgtttagtaacaggtaaattgtaaatattattaacttagaaagcaaaactagatataatctaattttcgcttcttcatcctagagaattcgatccagccatcgtaagtgctatgtggcaagactttccatctaagatatctacaacggatctccaatacgatgtactactaacaccatctaaagatttcggaccttggtaatttgaaaactctcctgtcgggggggggggggataagaatctaacaagaaaacttaatgtgtttttttttcataccagctcaattaaaattaaaaccgacagtgcaaaaacagagtttgacaacggaagactactcactattgatacgctgttattgactttcttaaaaaaagatgaccggacaacaaaaaaactcatctcgaacaaatctttaaatgctcaactgtgtaacagtggaaatataactcaagcctttaacaatactgtatccgaaaagttacaaaatgttatgggtggttaataaatgcatttcattaaaacttcttatttagtttctataaaatacaaagtattaaagaaatgaataaaacaaaagagtgtatagctcgaagccataaaatgcgtccatgatgtgcatatatagattaatctgtatattgtatagaatttttttaattctagctagcgaacttcaattacctaaactagaatcctgctgtgatgaatacttgcgatttacagacggtgatgtgatagaactgacatgtgacgacggaaacatgtgagtttttactgtatgggacaatacttttcgtcttagaaacaaactcatttcttaatttctcgttcgcagcatatatcaggccggaggtattacatactgcactcctatatatacgagtacaacaatcatacatgaaattaaacctacgcctaacaacaaacctacaaagactcaaccaatgccaccgtggattgatttaaacaaagccttcaggtgagcatcatttttccaaggaatgccagttgcaatttactgtaatttaaacattttctcttttagttgggaaggaataaaagctgctagaattaattcaaattatggcgccaatgaagatccgacaccaaaactactagaagtagaagaattttttgattatatttacgaagcgacctgcaccactgtggagatgcgttacccggaaagaaaagctcaacaagtattcgcaagttctaaagacagtaaaaaatttttcaagtcctctgtaaagagacaaaacagagatatttgaaaacactctttatttaagcttcaaaaatgtttacaaacatgttccattcaataaaaagatatacataattcaatatagtttggttatccaagttttaacaatctaaggtttaggaaattgctttctaagtacttctggcttaagcagcagacaaggggcatttttaaaacaagacagaaatgaatctgcactatctcctaaatgaattttaagtggaatctcataatcatagtacatctttctagttcccattttcagaaaagttgaaaatgtttttgctagaaaccaagttttttgagatataagatgatagccataaatgcttaaatttccatctaccgcgatgaaaacattagcattgaaatcattttgctgtttaaaggtggttacatatccaatgaaatacaagggattattttcatgtttaatcacagcatctaagggaagggcattatgaaccccaggtacacaagtatggaacactctgtctgccaatcttccaggtgtgccattaaaagcccacagaaaaccatgtaaatactttctgtaggctagcacactttgcagtgagccaaaattgtccataaactgtcttaattttccttccatgacaattccatatggtacagaccttttctcgtaaatacaatcacagcgtgccagtccatcctctataagttcattgagattcgaagcagctaaataaagttcaggttccactttatcattcttgtgaatcatgacccacccattttcacataacaatacagcaatgttataaattttggtcaccggttcttctgttcctacaaaacctagagttaccatccagccttccggtacgggaaataaattcttaacctcttcaatgttataatttctactcacatcaggcataatatagatcttgtgtcgtatcggccaactcaaatctaaaaacttgttacaatttctaagtacatatgcttctagactttctttagtatactgtaacttgcttaaatgcataaaagatttaacgctttccctcagcattttttttcgacatcttccaaaaataaaaacactggctggtctagggactgttttgacaaatctttttccatattcccctgtgggaacattttcttttaaccaaggtctatatggaatatcagcaagaagcctttttccctgtcgttgaaatgagcaattgtaaataatttgagcactgtcattgtgataatcccgcgatgaaatgtctgtttcctgccctatcatgtgctgataatttgttggcaacaacgctaactggtggttggaaatttttgtctgagccgaagaggtttgataatccacttctccgaaacgcacatcgtcatatgtcgcacttgctggcatcactttataaacagaatttaaatcttcataaatcacatcaccatttataaatcttctttttttaaaatgctctggacagatttctggaaagctgcgtttaaccgtctgcatggggacagcctctttttcaacgttaggcggaaacttgatgttttcctcattgttatcacaaatcagttcattttcacatatcactaatgggttgtctgcaaggatatcagtgtccacatccgatgaatccgaattgttattgaatgtatttttacaaatgtccaatgatgtagaagcttcagattgaataaaatccacttttgaagaaattttagtgttttttatatcatcccttattttcaatagctcactcaacctgttaaaaaatgttttcctttcttcttcggtagatatcttgcaactaaaatttaaatgtttaatattacccatggtcggtgtaatattgcgtttcaatagacgatatttagaatgattattaacctctgcgttactgtccacatccttgttctttgtagcctgactttctcctacaagaggattctcagtcacaggaaattcagtttgtacatcaagtgatatgttatttacatactcatttttaggattcattggaaaatgaacattttctacacacgccccagtcacttcatctgaaaaaacagattgatctgtgtctaggccaattttaggccccccgttagattgacaatcactatcaacgttagctgtttccagatagttgttaaagctgttttcttttccaatcaactgatatggactttgctgtgaaataatgctttggacattcgcaaaggtgtgctgtaacacagaactttgattatattgcggaaaatctgtattaagctctctcgtcgggagattctcatcataatgttcatttctttgataagagatactaacttctttgtttggatattttgagtctacagactcttgctcaacataagacatagcacaattttcaccaatcttagtattgtatccataaccattttcactaaaatttccattcattaaagaataagtttgaaaagcagatggctgactaaactgtatttgcatcgttgtaatgcaaggtttaaagccataatctttggatgttgatgcgtctactccctcatttctaaatggtataggcctgatgacattggtgccaaaattaaaattctctatagaaaagttatgaggagtgtttgagtgaaatccctgatatgttggaaaatatgttccttggtttccttgcaaactatcttgtctacaataactcagcacatttccatttcctatattattggcatagagatttctctccactgtttgctgggaagacatgttgtaaacaggataaactagtaccgtttctaaatgagtttgttcattaagcatgcaatttgaaggatccattgatgaatatgcaaaagtatctacagttgttgaatattgccggaattgaaaagcatctgaattcgatgagacttggtgattatttccgaaactatccccactctccatccttcttttgattacaactagaagtgaacaattaaaagttactttaaaaaactatagtgacattactcgttgattctgtaatttttaaataataatgcatttagttggctttctaaagtcatgtactttgtgtttttgttatataaaaagatgtttattctactaaataacaatttataagatattttctatctagtgacttttatcatctatttttagaaacagaaaaatacctattataaatgaaacatatttcaactgaatttatgaaaagaaatatctaaaacatttgatttcaaatagagcaaacttttcaaataaaacgtacaaatttttaaagccatagaactgcatttaaattcttaatagatactgtctttaaatgaatttcgttaaaatatggcatcattttaaaactacataaactttatgctttgttttacattaaactggctaaaaatatttattggaggccatttaaaatcaatacatataaattgacttactgtattttctttttttgaattttccaggaatgtgcaattacatccaatgttctataaatttaaaaaagagtcaataatttttacagcaattttcgaaacacatttccaaacctacgcaatgtatcaaatgaaactaaaaatagatgaaacagtaataattaaatacatatttaaaaaatgttaaacttcagaataaattaattttaaatttttttgatattttacactacatttagtaaatctgtcaaataacaattatttaatagatattaatgcatatttacaaaatcttttaaatttcacaataaatttctattaagaattttggattttttaaactaaaataatgtaattataaaatacatttgcaaatgtcaaatttttacctttatgtagtcttcacaagctttccagcagactaactgcgaaatgacggtgtctgcttatatacattgctgcgtaggcgtggctataacaacttacgtatgaataaattatttaaattacatttaagcagaaaaatcattggccggtttggattatgttgcatgttttatggacataattataaaacaacgtttttttcctgacgtttctgtggtttcctgttattttcacaagtttaaaaatcagtggcttttgcggttaaagtgtttttcgccttagcaggatgtaatctctagaatgtactgaaactataaccgcagttcctgtttattttcacatattaaaatgttagtgggttatgcggtctgggtctttcctacctaaacgggtgagaacccataaaacctgctgagaagtcaaccgcagttcctgttgttttcacgggtttaaatgtcagtgggttatgcggtctgggtgtttcctgcctaaacgggtgagaacccataaaacctgctgagaaggcaaccgcagttcctgttgttttcacgggtttaaatgtcagtgggttatgtggtcggggtctttcctgcctaaacggatgagaacccataaaacctgctgagaaggcaaccgcagttcctgttgttttcacgggtttaaatgtcagtgggttatgtggttcgggtctttcctgcctaaacgggtgagaacccataaaacctgctgagaaggcaaccgcagttcctgttgttttcacgggtttaaatgtcagtggattatgtggttggggtctttcctgcctaaacgggtgagaacccataaaacctgctgagaaggcaaccgcagttcctgttgttttcacgggtttaaatgtcagtgggttatgtggttggggtctttcctgcctaaacgggtgagaactcataaaacctgctgagaagacaaccgcagttcctgttgttttcacgggtttaaatgtcagtgggttatgtggttggggtctttcctgcctaaacgggtgagaacccataaaacctgctgagaaggcaaccgcagttcctgttgttttcacgggtttaaatgtcagtgggttatgtggttggggtctttcctgcctaaacgggtgagaactcataaaacctgctgagaaggcaaccgcagttcctgttgttttcacgggtttaaatgtcagtgggttatgtggttggggtctttcctgcctaaacgggtgagaactcataaaacctgctgagaagacaaccgcagttcctgttgttttcacgggtttaaatgtcagtgggttatgtggttggggtctttcctgcctaaacgggtgagaacccataaaacctgctgagaaggcaaccgcagttcctgttgttttcacgggtttaaatgtcagtgggttatgtggttggggtctttcctgcctaaacgggtgagaactcataaaacctgctgagaagacaaccgcagttcctgttgttttcacgggtttaaatgtcagtgggttatgtggttggggtctttcctgcctaaacgggtgagaacccataaaacctgctgagaaggcaaccgcagttcctgttgttttcacgggtttaaatgtcagtgggttatgtggttggggtctttcctgcctaaacgggtgagaactcataaaacctgctgagaaggcaaccgcagttcctgttgttttcacgggtttaaatgtcagtgggttatgtggttggggtctttcctgcctaaacgggtgagaacccgtaaaacctgctgagaaggcaaccgcagttcctgttgttttcacatattaaaatgttagtgggttatgtggttggggtctttcctgcctaaacgggtgagaacccgtaaaacctgctgagaaggcaaccgcagttcctgttgttttcacgggtttaaatgtcagtgggttatgtggttggggtctttcctgcctaaagcgagtgggaatgtgtagaacttgctgagaagacaaccgcaattcctgttgtttcaaagatttaaataccaattcgaaataaaataaccgcaaaaatcatgtttacgtaaaatataaatccattgtggtttttattggaaaaataatattttaaaaaaatacatgtacaaataaggttaaaccctaatttttttagtattataattttttggctttttttaattggttgatatattaacgtcattttcctgtgcatcacatccgcttcaaaatgtatataataagaagacagatcaactattttgccactttttcttcaagagcttgaagatacagttctgctacacagaatttccaatatatcgctgccatctggtaagtaaatttaaaatcatttaatataaattttaaatttattttttttatattttaaaaactgtttataatactaatattattaattttaaattattacaatactaatattaataattttaaattattacaatactaataataatttaaagttattttctagttgtaagacacatttaaaaaatcataaattacattaattttactttaaactctgacattttctattttaaaaccattaaatatctcatagtgtaagaaaatcaagtaaatttacttacaattttgttatttctgaagcaatgttatacttttgagctgtcttcatcaatttctgtaaaacttggatttgtataatctaatatgtcttctgagtagtattctgttggatttgcagttttgtcatttttctcagttagccaaaaattacaagttataataatcatcataactgaaaacagtgttaaaattccaaaagctgtagttagtgcctgtatccatccgggttgtttactgctaagagttggtttagaacttgcagaaaaatttgtcacagttgtttgatctacaagaaaaaatattcatattaacagagttacaaactttttttttaaacaatgacattttatagctgaacaaacctggagaattagatgttaattctggaacaacagtacttgttttatcattttgagcattcaaagtcgttctttgaattgacagagtttcaattacaattaatacagatccagttattattaaaaaaacaaataatattgccaaaatgatccaataagtaagttttggccttgatacacgtttttcatattccagagtatacatttttttcaagcagagttttaaaactctgcttgaaagtatttttaggctggccttatattgagtttggaatggggttaatatttctgattggtttgttattgtaggtgtggctaaacatacagataaaactatggaaagaagtggagctacttcacctatgttgattgttggacaaccatctgaaaccatggcatcgaatgacgaaagacatattgagtaggtaaacctaaatattttaatacaaaaaagacagatttaatttctctgtaataaaatttataaattttattacagatatcacccagataccaccgtggaagagaccatcagagacatattgcaagacagtttaaaatgcaacccttcctttgataatactctcttccaagaattggattcttttgatttccttgactcaatatcatctaatgatattgcaacggcaaatgcttcctattccacaaatgttgaagaaggagcttcctcggatattaaactggcagcaggtatttttttttcattttcttacatataaaatatgatatatgtgtacagatttcatatttagacttttttctttaaattctagctcagtccattagtgcctgcatccaaggtattcttaaatccgtgaatgctgccatggatcaggaaaaagcagacattgaagattgtttaattaaccacgctggaattttaacgaatgacagacacatgcttacagatcttgctttagaacaattatctcagatgctaaatgttaatttaattagtggtgcttcctctggatttatatctttttatgaagatatcttatctggagaacaattagaattttttctttggtgtgaatcaagatacactgtatatgcctgtgataaatttgatgaaattgttaaaaaagtgattgcagattgtagagaatatttatcagatttgagaaataatatggatagagaatttatcaaatgtataaaaaagatcataagtatgggcaactttataagcagtaatgagaaacttaacagatgtgcaacaatgttattaatgatgggaaaaaacagagacataacagatataaacatttccaatcaggcattctacataaaaacaaataagattaaaaaagatttgttggaatgtaaatttgaaataattgaaaaaaacagcagaatagctcaaactatgaaagactttgcaatcaaacagatgaatcagatgttcatgtcaatgtgtgacgaaacattccttaaaatacatttcaattgtataaatttaatagaggcagcaaaaaacctaggagctgctgtactgcagtgtattgtaatatgctctaaagaattttcatgcaaaaaattcagggcaaatagaaaagaatttaagatcacacttatgcatatgattaatgatgcttgtgatcaaatagaaaagctatatgatgtcacaggagaagttacagtgttaaattcaatatccattagaaatggatatgtcacaggaaatggacatcactcttccactttgcttgagtcacacttatataattctgactcgactccaccagaaattgaagattttaatgattatggaaagtattctgaggaatgttctgaaacatctgaacaatcctaccaaagtgtacatcagaatgtcagtcctacacagtgtgtttcaaagtctgaacagtacaatgttcaatcaaatttttcagacatatgccaaaccattaaaacaactctggctgtttcacaagcatcagatgaatcacactctaaaaacacaactggaaaaaatcctgaagtttgtaccagagaatataaattagatttctttgaagagatagatacacagaatcttgccaaaaaggttgtttcaaaagactcacctgactgtctcatgtatccagctgaaacaaatcctggaatgagtactgaagaaagtgaggtaaatgtttctgaaggaacagacacacaggatttttccaggaatactatttgcagattcttatctgataatcctataatctcagttgagaaaaattctgaagtgaatgctataaaaaatgagacggggctttccgaagcagcagccacacaggattttttcaaagaggctactatgaaaagctgcagggatactaaagcagatcaaattctaacaggacagagaaagactattaaaaacaaacagaaagtcagtaagaacaatgaaacctttaacatgagtttgtataaccttaaaagaaatgaggaaacttatcaagataagaactctttgaacttttcaaatgaatttcctcatacaaccttttccaggagagataaaaaaacagataaccaagctggaatactcatggaaaggtcagtaactgaggaaatttgcgtcaataactctttgacattttcaaatgaatttccttctaccttttccagaacagataaaaaaacaaatagcccagctggaatactcatggaaaggtcaatatttaataaggacacccaagataaagaacagtactttgaactttttaccatgacaaatcatgcattagataatcagaacaaaggtcacaatctgtctgaagacaaaacagatgttaaaattaaaacagataagtctttatcagggcaagaagaaatgattaaaaataaacagagtgttagtcagggcaataaaacctccaatgtaaattttcataaccttaacagaaatgaaaacaaatataaagatggaaaagatttaattattccagataaatttcctaatgaaaccttttacatcagagataagaaaaaggatatttcaactaatagagctgtagaaagatcaacagctgatgttgacacagaaagtgatgtggaaaaagtggccgctgaaggattgattttattggagcagaattccaataataacagtagagatacagataatacaaatctggtgatttctgagatggaaacatatggttatgatacagataaatcaaccatatatgaaagtgagagctccagcactgatacaaattctacattcagtagtgtcagtctaacatccttcagtgactcacagactacagcacatgatttcagtgctgttaaaaaaaaacaattaaagagaaaaagtgaaagcaagttgaaaactagcaaagcaaaaaaaaaaaaactaattgttaaagagggctgcaataatatggagttaaattcttgcactgatacagacaatgaaaacatgagtaattttaatacagagatgtctacagattctattccttacagatcaaaactaattaacaattctgataactgtgaaaacaatggattccctagtgttgttttcacaattcctatcagatccatacggggggtgacaagaggtgtcagagttaaaattgttcctaaaaaaaactgcctgtggtttttacgtaagactcataaagttaacattccagacacaggcatgaaaaaagatgaaaataaagaactgaccaaacaagcaagttattgttttaataatcattttattccaataagaagtaatgatgaagaatataggcgggaaaatgtctcatatatatttccaaaactccaagaaaattttattgaggttgacagcatttcagagactaaaaccatggtaacaaatattatcatggataattttatggaaatcacagaaatgattaaaaatggtattaatagacattatgaagaattaaaaaagagatatgcaaataaaaatgtaagtgagatgaactcatttattttagaacagagtgttgacactcaaaattatgggaaagaaaacacagattctgatcaaacttatgttgactttcttgaaggttatccacagggatatgatccatttttggaaaatgctcaaatctattaaacatcacttttccttttgttgaaattgtagtttttgcatatggacttatcaatctatttctattcagtttctttttcattaacttttataaaatatggacttttaaataaaccttaagttttttatactttttttacttaaatattttacatattagtttaacttactgtttacacattataagaatttggatagatacattataaatgtaactttcatctgtgttattgtatctatgaaataaaatttttcatttttttcttataaataaaatgttttagacctatcaaatttatctcatagcttaaaaaatacattgaatataagttttcttatattgctagccctcctaactataatagcctttcacttgaataggtatctttactttcatagcttaaaaaaaaatacattgaatataagttttcttatattgctagccctcctaactataatagcctttcacttgaatgggtatctttactttcatagacttggaattttcataaataaattgctttgatatattatagttccataagcaggatggaaattttttcatatatatcttaattccttttctaatacttttataaccactgtaaaaaatcttttaagtatgtaccccttttgaaaaaaaaaattgtatcagttctaaactgcatttatgtttttcaaaataaatggtttgaaatttattttgtccataagatttaattacatagaatttaaaattaatcattataaataaggctatgctgattaacatatttttaaatatatacaaatttttgtaaatataaacatgttctcaaactgcacacatctaattaacaacattgaatctcattatttagaaaaatattaaaatcacaaaattgacatttacaattaactcatagaagcacatttcattagtttttaaactttaaatacatatgttctttaatttataaagctgtactagtaaataacatatttataatacatatttttatttaaatattaaaatttttattatgtaatatttaaatatgtaaatcttaaatatagttaaagcaataggtctatatgatttatatttttgaagtttccatgctacatattcatacatctgtatttcacatgattaaaacataagttttaaattttaatttgaatatatacaaagacacatttttgcatataaaagataattagtgattggttttattttagtaacattgaaattcttataacaaacacatgaatattttcaacatttatgccatcttcataaattatcaaaatttatacatatatgatactaagtaaatttacttataacagggtttgatttcaagtattttattctttattctacgtacatatatttccgtacatataaaatcatataaaaagtatgccccccaagaaaaataggcaaagattggtagctataacttaaaaatttaatttatgtttatattattataatagatcacaagatctacattttccacaataacatgtttagaaatttctatatcatttctttgaaaattgaatacattcacatacattacgtacttactaatacacattaacatatctttacttgcaaccatactaacatatattaacatacccatttatatactcattcatagaatacacatgaccttacagaaatccaaataataaacttccacgcattatcagtatagcatgtactaacatgtagcggcatagatcaaaagttattaacatgtactgttatgtattagcatgtgcaaatatttactagtgcatgtaatcatttactagcatatattatgtaatatgtacatattacataatatatgctagtatgtgcaaatatatgctagtgcatgtaatcatttactagcatatattatgtaatatgtacatatacccacatgaacacattagtatgtgcaaatatatgctagtgcatgtaatcatttactagcatatattatgtaatatgtacatatacccacatgaacacattagcatgtgcaaatatttactagtgcatgtaatcatttactagcatatattatgtaatatgtacatgaacacatatgtgttgttacatgaaaaatgtatgcaactatatatttacatgacaatgtcatgtaaatataatctaatacaagtaaacactctacttgtttaatagcatgcagtagcatactacaatccattgatactaatacatactaacatctgcttatcaacataaatacattgatatgtaccaacatataatatttacataaacatttaacataaactcatatacacagcaacagacacaaacatgtatcaacatttgtacatccattacaattaataactgcatgtttgcaaattagctcttttgacataaccatacacatctttattacatttacatatccgtttacatgtaaattgctacatttggaatgtttccactttaatatttattgtcacaaatttgtacacacattagctcatatgcaggtttcagggcccatgaaatatcaatctaacaagttacatttttaactaacatattgcgttatattttctagacaattaaaagtacatttccactctatttaaaggtatatatcatcttagtattatcgctaatttaataacattttaaaataaacaatttttatttttcattttcagaaaaaagaccattgcatgcacccatgagcactacagctgacgtggttcgtgaagccatgactctttcgggtttatataatgaaattcacgatcatacaaaaccagaaaatgaaataacttattcaaattttaacaaccaagaaatagtcacatcaaaaactcttcaagatccgcgacgtgctattcctcttaaatcaagaagtacttttacttctgaatcttctccaaatacaactgaaactggacaatttcgatttgcatcagaattgccacatcaaggactgcaatcattgtattataattatcctcaagcaagtggagaaaattttatctctttaccatatcaaccccaatcttcagttgatatttttaacaatttggactataaaaatagagaactttgtcacaattcgttcgatacaacctatcgacaacatcattacaggggtcgcaacaacagaggaaaatatgacagtagaaattattgtaaccctaactcaaaataccaaaatcattatggtaaacattttcacagaccttacaacagacgtggacgtggctatgctaaatttcatgacttttccaacagaaatgaatttacctttccggaatatatgcaacgagatcagtcatatgactcatacaattcagattttagacataatccttacagagacaattatcaacaactttgtcctaactatggctttcaaagcagagattacagcatggctttttcacaaattccaagcagctctatgatcacagatagtcaaaaccttcaaaaagaatgtatttcatcaggtcttacattatcaaagaaaagtgaatacagtcaaaatacaccaattcagacaaatcacaaggaaaccaaattaatctcaaacgtgaacaatttggaaaaacctgccaggaaaaagacagacaaagacaaaacaccacaaaatgaggatgttgtaagcttgtcatatattccaagttctcataagatggatctaattaaaagaatttataatgctgatatagttcccctggctaaagacagtctatcttcgacttcagatgtagacaaatgtaaatataacaagtcttcacaggaaaagacttttatgaaagctagaacaagacctagtacatcaaaagaaaaacaaatcacatcgactacagattctaagcattgtcccaacttggacaaaggttcttcaaacttaaagaaaaaggacaaatcaccagatgaagctatagaaaatctcagaaaattatcaaaactagaaccaatgctttctccactgccattaactcctaaaccagacgtacaggaatcaaatcaacgagctccaactaagttgattaattttaaaagactcctagaaaaaaatgacaaagacatttctgcttctgatatagaattcattaagcaatcttcacgctgtacagtaagtactgccttaaattgtaattctagtactgttttctctgatacaaaatgtacaggaaaaaattcatatcgtgtaggtagacctagacaagcaaaaactactgttaattccaaaatagatgctaaggaaaacgattttgaggggaaagtcacagcaccatgtaatataccttctatcgataatccccctgtagaatctgaaaaatcaaatacaacagattccatgtgtaacgacaatcttacacaaaggacacgatctgattcaagtagtactgaggaaggacaatataaatcaccagtaaatgattattcacagtcggaagttgaacatgtacacagcatagaaaatcaacacatggaacagatcatttctcaaaccacagatgaaatagcacaaaattttgtaagtcctgaacaagaatttttagctaaatcagacacagagaatgggctatttgaattctttgataatgaattacaatgcacacagaactcctctgaaacaaaaaagtttcctataagtgatagatctatgagtccaaaatctacacgaagttcatccagtgactctgatacggatacatcgagttcaagcagcagttcaagcagtaaatgcagttgtaagtcatctagctcagcatcttctaaaaattctgtattaagtagaaatagttgttcctctacagagttaaaaccttcatatacagaatctcctaattctaatggcaatagacagtgtgattttgttagcaaagttgatatgtcagaatttgaattcaggtgtggaaaagagctaaatttgtataaacatgttgaatctagacttcaattagatcaaaacaatgaacatttgtataatccaagatttcgccctcacataaggaaaaagagaccaccgagcacagagtcagaatcggataccaattcagatttacaatcccaatccttttcctcttctaaaaagagacggcacgaacacagaaacactgagtcagaatcatgttcagaaagtactaaaacaagacatcgccaaaaacacagatctagaagcagctctgatacatcgagatctagatctgcatctaaatccagaacatgtaaagtgtgttctaacaataaacaagattctcagtcggaaacacaatgcaaacatttgatatctatatctagatcaaattcagaacacagtatttctgaaagcacttatcaatcctgtaaaaataagaattcagaaactctaagaagtagaagcaggtcttctgaatcagattgcaaaaaaagatcggaaagaagctgttctaatcattcgtggtcttctggatctacacaaaaaagcaagcgtgtagatatagattttactcatggggccaaaagtattccgaatgagtatgaacaaaagaaaagtactaataaattttttaaaaataaacgcagaaatgcgaggaaacgtttttctgatgattcggactcaagcatgcagcttttctacaaaaagcggatatctggtacccaaaaatctgactcagaactatctgataatgatttatcctacagggagtatgtaaaattacaagagcaaaagcaatcagctaaatttaaagtacaacgtggtcgtgttcccactaaagattttgaaaaactgtttcgaaaaacaatccgcgcttttgaatataaacaaattccaaaaaaaccgtttccggaagccaaattgaaagaatcggtttatgctttgtgctgcaatggaagctctaaatccggtgcgcttataatatattttaccaggtcaaaaactgttgccgaagacataaaagccatgcaaaaagagctaatggtaagacctaatatcaccatgtctgaaccctttaaaatgaaccacgcccccccgcgatattatgacaaagattccataaagaatttcatcgaattacaaaaaaaaggaccgcatgaattgtgggagaacattagtaatagtgcacatactctgtatacaagacattcagatctcaaaacaattataatatacgctgcaacaccaatagattttttcatggcagctaaaatctgtaacaattatgcaaaaaagagaccaaaagaaattgttctgcgattaagctctatcaccgatggggataatccgatttccatctataatcctgtaagtagagattttctttcaaaatacacagcactttgtaaattttaaaaaaaaaaaataaagattacatttgctttaccccaaacgccttatttttgaatgggtgggtccacatttaaaaaaaaaaccacaaaaatcaaagtaaaagagaaaaaatagtggttttttagggtgtgtccagataatatagatgcagaaaaatccaaaatcagacaatttcacacaatgcctttcttaggtgcaattttcataaagatgattggattttctgtaatcatatatgcattatatccaataatgcatcatagagtagaactaggaaacacaattgtatttcagtgtactgttgatacaactaaaaatctcagctctgtaatatggtttaaacattacgaactgatattaaatcataccataaataccaaaaacctgaaaaacatgagtgaaaaaatagttcatgaatttaaacatcgtgacaaagaaagcattatttacttcaatgctaacaatatcacagcattgctgaaatttaaatctcgaacaattaacgatgctggttgcttaacatgtgcattcttcgccaagactcgattgtctactatgagttgtgtgcatctttcaatgaagccaataattgctttgtactatcgccatctgcaaaattttttggatgtaacatgttctgtgacgtcgtatccaaagccattagtagccattttatttttagataagatatatagacaggacagtccaacagtgcgtgaaaattacaacggctcgcagacaacgacactcagctttctttttaaaagacaaggcagcaatacgttctttggcaaaccgatcacttgtctgtcttacggcggagagatagacgagaatgttacctcgattattcaaccatttgaaaacccctataatgatacaatattaagtgatgattctcttaaacagtcagagttaattaacaacgatttggcgtggataattttaataatctccagtgtcctgcttttcgttataatagcttcaacccttctgtgtaaactaggaactcatcaacattgaaaattttgaaagcttcagtacttgaatatgaggggcaaaaaacgtaaaactgtttgtaaggccaaaggtaaactcacttctaaaagctgcatgtgtactaaagccaatgctcgatatacatgtaactgtttttcaaaaacgttaccgtttaatgaaaaagccataaaatgtacaattcctgaaaaaataaattctgaaataaacatttcaaaatcagaaatgttacttaaggcggacaaatatacgaatgccatctataaacattctaaattgagaaaaatatttaaggctgtaaaagaaaatctctcaacgacaaactttgcaacaaaatctaagggtattgttcacagcaattttaacgattccaaacctatccactctcctgaaataaaaaattatacagattttaattgtgattttatgcatccatgcggtttatgttcgccgaaaaatttcttatcggaagtttataaattacttcgattttataattcgactgtagttcaaattcaagtttattcacgtaacggattacttgtaaactcacttcacgaaaaattgatggaaatagctaatctgattgttaacaaaggcgaacaaaccgtttctgagacctttttccatgaacagaaaactgccatagcaattaacagatttctcagaggaacagtaccacatactgaactgactagaaaagaagctatgatgcctgtgaatgtcaacagcaaacacaggaaaaatagtggtgtctactctctgtacataaatgccccaactgaaaaagatctattttgtgctgctcatctctgtgtccaattttcaattcgttaccctgctgacattttactaaatgtctcaaagttaacacaacctttattacttaaagagcatttaatcatctataatactttcaatagatacatctactgggacgattatggtaaactattaaagacatagtatattttaaaacttatgtactctgattgactcgaattacgttatatatttattgcttaacttttggaatgatataaagtttatattttctatagatcttgactcagattcgacttctaaaaatacaacttctactaatacaggtaaggaaaacctactgttaagaattccagattttctgtttcagagtatttaagaacagaatgataatttctataatcacgaaataattagaaagctcacttcaaaaacggtatgtaaattattagattccatttaaatgtgtcttccatatttaagttcctggtgttttgtatacaactttatggaacatgaaaactaacatcttttttatatttcttatctccattctaaaccaaatatatgctttatttaataactcttattattctaatttagaacaagaatgtatcaaaaacattctaaattgtacccaatcaaaaactctgtcgcttctggaacctattgatcaggcacctataccaaaatcggatataatttctcgcttattatatcatactccctatatctcaaggagagatcaagttttaattgatgaagattttttagaaacattttacctactgtataataatcctaatcaactacacaccttactttccttaattaaagattcagaatcagggcacaactggcttggctttttaaataactttgaaagatgtctttcagataacacacttttaacctgtagagataatgtgtgtaaatcatactcttatgaaaaactcaaattcacgggcaacatctttgtagaaaatataatcggatttgaattcaatataccatcaaatatgataaattttaacatgtcaattttgatttaccttgaaaatgaagagactcgcacacagagaattgtgagaattgatcaccatggaattaatgtttttgatgctttgttaaattgtttgagatatttttctaggtattacaactttagtttcccgttaattcaagaaatggaaaaatataatgaagtgcttccattccgaagcgagttttcgaatttgctcattagaacttactgacgcatgctttatagatcgctcaacttatgtgtcacgtgttcaggcaacattaataaaaagcccatgaacactgcttctcccattcaataatggcattactacagtggatgctggaaaacatttcagatgacaactcaataaaaatgtctcttgaagaacaacatgaaacgtttcaaatcaatgtgaagtggcttaagtttttaaacttatcagattctgacattgtacaattacaaaatgtatacaaattggttcagcgtgacagagaaagattaattatctaccccgatcctcagaatgtacacagctggagttatttatgttcgcctgaagagattaaggtgataatagtgggccaagatccttatcccgatggtagaggtcacggattagctttcagcactgtgagaggatgttcccctccgaattctttaaaaaccatttttgcagaacttgaaagaacaatagagaattttaaagctccagcccacggatctttaaaatcttggtgtgcccaaggcgttttgttactcaacactgttttcacagttataaggggagtaccaatgtcccatgaagcgattggatggcaagttttgagcaaccgaattattaaccaactatcagaaaaaatgcaaaacttagtttttatgttgtggggatcacaggctcgcaaactcgtgtctttaatagattcaaagaaacacttgattttggaatgtgcacatccatctccgagaacaaaaggatcaaaaacaccttttatcggttgtggtcattttttaaaagcaaataaatatttacaaatccacaacaaatgtccaattgattggaacataacaaacgatttataaagtctgtaatatggaagacgccaataaatcttcattacgccttaaagtctccgtgtcactgtcactgtccaaaacaatcggtaacatgtcttcaacttctcttggagtttgtctcattgacatgtttctggatctgcctctgcctcttggccttcccctggaacgtcctctggatcgagtcgaaaccgtcagcatctcagaagtttcaattggttgttcaaaagtagaggccgaaaatctagcggagtttgagtttcttcttccacgagtactccttctacctcttacatttgattttaaaaggttgacatcaataaatggttttatttcacatataggaacaaatctattttgtgccccaaactgtatttgttgatcttcaatatgcttagttttagaagtacatttagaaccccctgcgaaattcatattttcatcagcgaattttacattttgggtaacatcttttttattatcctcattttttccccgcgattgtaacagtgactgttgtacagcttcatgagtaatttttattagtttctctctaaactgctctaacggtttatttatacaaaaactttcatcactttggactttcttgcatacagcgtcttgattcttcccctaaaagaaagaaacatctttaaccacataaaaaactgcaataaaaatgcatcataaacccaaaactccacccacctgcccacaaatgcgcttgtcaaaatcctcaaattcttgatattcctgaagatcaatagaaatagtgggcgataacgcaccctctggtattctacttgataactgactcgaagaagcaacctcttcgtttgcttgttcttccgcatgacgtttttcgtgatgcactttcatccttttttctttggatgcatctaagaaaacatgtttatgtaaaaaccttagacactacaaaaattcaacaagtcatatttaggactagtgatttagaaaaaaggcaactaaccttcgaggtcttgtttttcgtttcgacggtcatcttctaattttcttttttcggtgtcatctactcttttttttaggtcttgtttttcgtttcgacggtcctcttgtagttttcttttttcggtgtcatccattctttttttttcatcttttttatcacagtcttccaaaattttttgctcagaacggcgtttatctttttgtttaagagctttttttttataatcatcatcttgcttttttcgttctgcatgttctttttcaaacagtttctccagtttttggtctttgatatcacaatcaaggccgctttttagaactgtgatataagttaaatgcaattttccattgtcatgacaaatcgtcaaaactttttcctttccctcgtttttctgagaaattgaagtgatgtttttagaacataatatatgacctctggcactgtaagttttgcactgccctccctcagtacaaatatccaatgtcaatgagccggccgtatcggtttctgaagtccatgaaatcattgaaatccaaccattagagagcatctcacattttccagaattagcagaaaacataatcatgcacccagtttcaaattcatatcgtctcagctgtaaagtatgactaatgatctgctgataagcctgggttacagattcaaacgttccatattctctatcctccgcaatcattctgtcaataaaagaaataacgtattcagagtcgagtacaggttgaaatagaatagggaaattttatacttacctgcttccactcactgaaaaactcacttcttactacgagtctaagtgatttctcaaggaatgtacttcacagttcttgactgataaagttgcttcctgacacaaaagcatctcccttttatgctttctgacatgaaaattgatttccggaatgtagccaacaaaaaccctcataacttaaatcgtttttaaaaagtcgcaatgatatttgcctgaaattgtttcgcataaaccgtttttgtattttaccgttcgagaaaaaataacggtttacttccgcgagtttaaccgcaaacacgacaagttcacggatgaaggaaattgcgtcatatcccccagggcgtggaaaactggaaagcatttgtttataaagcccgcgatctacatgaactgttaagacagcgaaagaggtgagattgaaatttaatctttcgaaaaactcgtaaatatcaaactctgtatcgatgtctgaaaatagacaatgattagttaaaacgataaacttttgtataacatctaaacgatatattttttcaatttttatggaaattgtacttaacaagttatggaatatacggatttttccttttttgtatttattagataaagctctattggatcaagatacacggagacaatgcagtcaacactactactcttcagagaagaaaacaaggtaggtgaatgtttattctatatttaaatcatcccaggtaaaacagccagttttaggttgccttttttagacgaggtaataggaaaagttgtatatggactgacacacctctcacgaatataagtgtatctagactgccattatcacttgaaaagccatcttctttatttatgtatattttttttgctatcacgttagtttttatgaaggaatgtaactgtcggtcactggttttattgctacagttatgccctgttcacccaccccaatcttaaaagtgtatttgttataggttctcccatctcatagtttcttctctttaacttttcttgtttgatatgggttatcccttcccatatatagctttttttctcttgtcatatcatgtaagatctaacactaaggattaccagtaacttttgatcttgtgtaagtcatcaaccaaaaaaccatcaaaaactacaggatatcctacaacagtgacatcattgtttcaaatctcagaatttttacaacgtgtattgccataccatctcatacctgattaagaccgccaactgcataactttttgaacaacgggactgtgtattgtggattgcgattcggataccgcgttttggaccacagtaaccatgtaatggctactgtatgttttaaacctcattttaaaactatgggaacggctgttctcatttataatgtaaaccacagtagccatttacggctactatgtcatgatctgaacctcactttgtgaagacaatgagaacggctgttctcattgacattctatctttctgtacaattgcttggaaatgatctgtggagataagtgatgttttgaatctaaaatcttgaactatctctaaagcatcttaaccgccgaaaacttgaacatgtacaagaaagatcagaaccattacgattttgagctgcatacttgtaaccattaagagttagcccttgtactatgtttcagtgtgtagtgggcaacacaccaacataatacaaagacaatccatttagtggggtccgggatataatcaagaagggtgggggtgggggtggggaatggggtaaaatcatagtttttaagaatagttaatcacttttaattttaataatagctgttaagaataatcaataggttttgtcatagatttttaaggttaagtcatagatattaagaataagtagttttagctttctgaatgtacaattatcagcattttgcatgatttcataggctttttccataccttaaaaagcaactctagattgttataaaattgtgaattgtgatattcatacaaccttcagtagtgtgtggaaaaggaactttagttgatttctgacatacttaaaatagacaccatacataccacctgacaccgctaactgccatcaattttaaatgtagaataaacacgcctgcgcaatccggagtacatttgtatactccggaaaagtttttccctttacttttagactgcgtctttgaaaaacctggcataagaatactgcagtcctcattcaactggaacaaataactacgcagacggtaaattttgtttatatttattttttacctactttatctagatgtgcaaaagattctaagcatttttttctttgcagattcagaagatgaaagatttctaaaagcctcaacttccggacccagagtatttatcattttcgcaataaaatagtgtataccaaatcattgattcatgtctttatttttacaattgccaaccattaaaaacataccagaaaaaagcacatcgatacatgaaaaacttaatttcaacttagtttaaaaaaatacgtcaatcaacacaaactctggcatttaaaaaataagcatagtatctttattttttaaggcctttacaatatgtgaagcaataatattatcattttcatagttcaaccgtaaagggttcagattcataattaaattatttggatcaacaactcttgacataccaacatatatagaactcaactttaaatttttaggatcatttccaaaatctaaggcaaccctttgtatagataagccttgactttttgtcacagtcattgcaactttagaaactatggcgtaatctatggttgtacagatatgaaaactgttaccattgacagtgtcagtaagttttgatacattgttgtctaagatcgaaataaagcccatttcatccttgataacaattttgggtaaacctcttttgtaaattatcggaggaagcattttatccgtccctaagaaaatcacattatcataagtatatccttccaaagtataattattagcaggcacagcatatgttaacatgccgtagaagcttttaacatgtgaacatatctccccacatcttttgctcgaaacattattcctattatatgtgattaaattactcttgccgaacatttctttactgtgcctttgtagaattgcaaatctagaaatgaaaatctctttaaatactgtataaaggtaactgatttcttcaaatgttagaacattcgttaatggaagttgcttgtactttaaaaaaaaaggatctgggcacggatccgaagctaacatttcttcatctgtaggtgcaatgtgtagatcatagtattcgtctgattcatcgaaggtttgcaaagaaacttcagctgtcattgtttgtagaaaatcaatattgggcaatttgatctttcttatttctgtcattacttcagaagtcgtgaattcggataaacagaaagaatacatacccccatacattaaacctgtcaagaaggaataggcgtgcacgctatattcgcatgctgttttttcaataaataaatcactttgcagaagctccacaaatttttcatatgtccctgaaaacccaacagttgaagattttgttctggaagtaacgccaatagaactatgttttatatgtttcaaatgacacgttatcaaagtttcctctaccgaaccatcatctaatacaatttcttcgatttgtatggtcttagacaaatcttgatcagcgaattgggaataagtatttaatctgtgtaaattagttttaaaccatggttcaatctctaaagtaaaatttgaaatttcatttttgtaatcttcaaatgctttattctgaattatgaaataaacaggaaaagtaaaaagattatctttatttgtcagttcgacctgctcatgtaaaactttaaaatatgacttaacttcgtaatgtgataaaaataaacgcgtcattccaatttcgtttgtaggatttctaatataagttgccggtctaacaaacctatcaacatactcaatcaattcaggtttcaatggcaaaccaaattctatatgttttaaaaattcgccgaattccacatcagtgcatcgtttattattaacaaaaatcacccaattttctgatattttacagtaatttgatagaatgtcgtcacatattaaagcggataagatatcaaatcctttctttacgtctttattttgtgttaacggattaaacgatgaaattaaagccccactttgtgtaggagatccaacacatacaatacaaggaataactctatttttatagagctgtgttttatgaagaccgttataaaaccaataaaaaaagacaactgtatgcaaaatgtgccttaagatcactcctgcttcatcaatcacaatcacactgctttcacatagatcaggtattactttggttttcccatttgccgcattcaaagctctttccgctatatctgcgatgacgttccaatatgtagataaatcatgtttttgctgatccgcaatcgaatctaaagttgttactgaacaactaattctttcattcatagatacatgtgaactattaaaaccaaatgttttaaaaattgttttcacttgcgcagatttggttctgttcaataaaccactaagattttgagcagcaatggaagtggtagcagttataagacaatcactattagctgctaaggtttgaatgctgcttgttttgcccgcacccgcagtaccggttattaataatactctaaaaggtaaaaatggcaacggttgagcaaattcttcatcacctatagaatgaatttcttcaaaattgctattaaattctaattcaggatcaagaatgttacgaaaccagtcagttggtaacggcgtctctaaacaggcatcagctaaagctgcaactttctcaacaatcaactccaccttagcagcagatgacatgtttaaaaggaattttgtgtcatatttaccattgaataatgaagacaatgacattttatttccttctattaagactataaaatttatagaaatgctacacggtaaaaaagaattctttaagggacaatctatacacagtgttcttagagactcggctgtctttaagaagcaaatgttttacacactgtcacacactctcttgaatagtatatccatccagcagatcaatgctgaatggcaacgtcatctgaaagcatttccgttccgcagcaaaggcatgtcatttcaagaatattttaatatctggtattatgcaatcaaacaggtaatcctggaaggcattttgcaaacgataaactacatccttcaaaatctcgataacgacatttataataaatacattgattggatttgtacgattggaataacaccaattgtcacattaccaaaaaacaaggttacgctgacacccttagcaaaaagtatttcctctagattgattcaagaaatcatacgaaacaaacagaactttctactgcacattttaacacagatctcctcaacatctattgccgatttcaccaacataaacatttatcgaaacaagtcagacggcaatataacctgtctctccaataacaaggaactagagtactttgtttacagtgcaccatatttcataaataatcaattgctgtttacaacacccctagctcacttatactcagaattgaataaacacgaaaacctacacaggcaccgtaaaatgtgtcaattgctgaatacttttccaattaaagttttaactacatcaaagaacagtgttgataacaaaaaaattctagaacttatagaaagagaggaaaaaaccagcgatgcgaaaaaaagtcttataaagtttctattaaacttgtccgatagtaaatctaaaattggaataacagatagtattgagggttttttacaagacatcacgccgtctataattgaccagaataaattattaatcagcaaaggaaatttgcaacgtcgtgggcaggacaataatgatcgcgatattagagatatcttcaaaaaacaaatcataaaatgcatggaggaacagattcaatcacaactggacgaaatcgaaacactgaaaactgcaaatcggctatttgaaaataagattaaagacatgcattcattaataaatttatccgaaacttctaaacatgactttactttagattcagatattgaaagcttgtctctcgctaaagctctgaacaaagttcaaagtctcccattcactagtgtatcaatagacgacaccagagctgtggcaaacagttttttttcacaatatattccagatattgaatacgcagacaaaaaaattgatcaattatgggaaactgaatacacaaggacattccgtctacgaaaaaatgtcaacaatcaaggacaggaagacagcatctcatattcaaattacacgctagaattgcttcttatacccttcatgaaacatgttctaaaattaagacattttgaactgctcccagaagagtttctgttcctttctctaaaagagattatgttagctgtgtactcaaactgtaaaattaagcattatttaagattaatctatatacggcagattaacgagctttcgcatttaatacatactcagaaacaaagtgatttgactttgacacctgatttaggatccacaaacccagaagattttcaatatccgcaagatgacgttgccagcaagcttaaaaggattcgaaactctagacatattcaatatatcaagcgtccggaatatctgtgaactaaacaaacacgccgaacacgtttccattaaaaatttacctttaattgatatttcggttggaaatgatgatgtatggtttcatttggaagatggcacaattgtaaatggcaaatcctataaaagcatatgtgagaaaacattagggtttctaggcttcattggcattattcttcttgattccgaagatacgctagaagagattcggctgagtaaaactcaatgtaaacgaagaatcatttatttgattttaaaggaagacacggagtttttactctgtggtattgtatatgctctagaaaatctaccaataaaagggcagacactacttaaattacgagatattattaaaaaaatcagtgtaactctgccagtctctaaacttctagcctgcacctgtcaaaaattgattagtattttaagatacattttttacgatgacaaacagcaagacgtactggataaagttccacccattattcagctctattatgagtcaaaaacagcaaatatacacatgttaaatctttttttcaaatctcacgacaatgacgacacatgtactctatcactaaacacgagacgtttgcaagacgactctaaatatttaatagattttttaaaaagcgctatatgcgatgccttttcaaaggaatataagatgacagaaatagaaaaaactagtttacattaaacaaatgtaaatgatcagagatgatcttacttcctaatctaacagtttctgcatactcttgttgactatattttgttaagagccactttttgaaaatttctatcacaacctggatgtaatgaataaaatctattttatccgttaatggataaccaacagattgtcttattagtttgttttctgttgtccagacagctgtatatctattacagtctagtaaaccttcgtgtgtctctagaaaatagttgttgggctcaaaatattcgatccaatatttattttcgtatctgtgacttagaaaaacgctaaccatctgctggaaatttgtgtaaatatttttaaaatctactgtaatctgacttgcccctaaacaattatataaacacttgctagctgtgatagtccaatgagaatcttcactattgatgtctccgcttgtcaaaaagctacatgagctgtgtaggaaattgtaaccagggatgtaatttatgttcactactggagttcttgaagaattgagaatttttttccaacaactttccacagacgtttttaacagaggaagtactacagaaggatccttttttggacctataaaatacacaatatgcatgtttctaataaacatccaattaagatccattaatcgacacgcgtttaaaaaacatctcaaaaactctgtgattttttttacgatcttacaaaaaatgttgttagattttttgtgaagtcgagatataaatttcaataagatttcactttttatataagcatcgctaaaatctgggagaaaacttttaggaacatatagttccaacaaagattgaataatgtctaccaatttgacaataaacagatcctgctctccaaaaaaataatacacattctcagaattttctactgtttccattgtaacaaccaaactattatatttcaaatattgtaatgctcccaaattgggaaggtcttcgaattcatccacacactgcgtacttggaacactctggcaaccatctggtcctagactatctggcaggccacagtaaagtaaaattctattgcaaatatttttaatacaaggtatcttgttgtccaaatcgtaaatcgataaaaaccacatattaggaaaccctacaaaataaactgccctctcatgtccttgcggccacaaatctggaccaatgtaatcatgaacttgtttcacaactaacttatttcgaaatagattgtcatacaaaaaactaacaactgtttgcagcaaaagtagacacatgtcctcatcaaataagacggtaaaaaagtttttaggtgtcaccattaagaattgttcttctgccaatttatatgtttgtattgtgaaaaactcaagcaatttttctaaaatactttctgaagactctgtactagaaaacagtacttttttaccattgacatttaatgagaaacaaaagtttgtgacgtgataatcaaatcgcattttctttgtcgcctgtgtgcagtctgaatctgacaatagttcagaagatattttcgaatagtttccaacacatcttattatcattggtcttaagtctggcatgtacaaaaccgcattactgtctatgcagacatctattatttcatacatattagaatttaaaataattgttaagaaaataaatgttctggatagtttttgaattatttgtttgttgccaaacatcagttcacagattgactctgtcttttgagttatactcattatttgttcattcaaatcccacataaagattttttcttttgaaatggaaatcttatcaaggagattttcagaaatctcatttccaataaccaaaaaagtatgcaaggagtgagtctcagcattaaaaaacaggcattgataaattggtactctatattgtttatttttccaatcgttatgaacgcaatagacacccagatgacaaacacatccccgcatctgcatgctggaagagacaaccagtttcactgatataagaacttatattgtgacctagtaatttataaattttttttctttgtcttttttttgaagcttctgtcagagccttacgtaactctttgtaggttttcagattggttcttgatacgtgccacatgtcaagtaaagtttctatttcccttttcgttagacttctaaatggcttcccaacgatatatctgggtttactcttaaccagattcatattaaaggcacatttgaaaaacatccttattattgaaacactgaattttgcaatcgaaagtgaccaggtatttaattgcattccctttaacctattgaacaaatataacgtataactgttgtatttttcaaataattgcacgtgcgttgtaaaaacaatttgtaaaatcctaaggatttcagatgatcttcttgcagcgcaaagtaagatagcatcttctgagatgtcagtttgcgtatctgtacaggactgtaaatttaaatccgctctaatagattctgctaaaaaagctacatccatcaacataccacattcatgtacgcctgaaatatcacttaataaataaaacttgctacatatatagttttcaggtagagtaaatgttttgattcgggatttaaaaaacgctttaatcttttccacatcgataccggtggcaacatatttttgtagcaaagcatttataaaaacaaacctcctaatttcagattttaaagtaagcataatctcttcaattacaaaaatgtcaacatcatttttcaaaaataaattctggaaattatttaaattaacaatgtaatctttatgaacttggaaatttccaagttcatagaattctccgttaacagtaatatttgtattagaaaacaattctttcagtgtcatagtattttctacaaagtctgttttcttcttttcaaaaaaatggcaaccttgaaccaacatttttgtaaatgcgtagaatttttctttagctataggaaagacgtctccatcgatgtgaactttaattgaattactatccaataaaagacataaaagatagagactatcaggaagatttaatagcgtagttttttcaatataatgcctaattctaaaaaattgttttatcatggaattagacaagtagttttgtgcactgagacattttttattaaaatccatacagctgcattgtaggattgacttttcaaaaagtgtccaatcatagcattgtggaatcgaaataggggatacagaaagaggcacctgaattaatgcaggattcaaataaataaaaatttcgttgtctgtgacctttctaactctacccattgattgaaaaaccgaaaccatatcagggccaccttttaccaaatgaatgtaaacaaacatagctgaaaaatgtagaaagtcaaaactgagcccgaccgttacaatagatgtataaataacaatattatagtttatccaactctcgacagaatgacatttgccctgcttagaagttaaaagcaaaatttttttatccgggaaatcagtttttaacaattctgacatgaaatcggcagatgtaactgtgctacaaaataagcaaatgttttttcctaagcctaatttttgttttagaattccataaaatgcaagattcccatctataaaagttggacaaaaataagcagatctattagaaaaattcgcgcttacaaacgtatttatgatcaatgcagacttaaaatgcggcatacagagagagaaaaaatccaccacataacgattgactgttgcatccatagctacgatctgtgttgaatttctaataagcgttaaaagcttagcatctacttccttgactttagtcatggtttttgaatagaactgttttataatagacattatttcatctagtattaaaacatgataattcctggtaacacgatgtaaactttctacttgaattatcagtttgttcttgttgatttgacgctctttaatttcgctgtacagatagaaatcgttcaaatcattcttcttgaatctatttaaaagttctgcagcaaaagttttacgacaggaaataacaaggacagaatcaatatatgaaacagttttcaagaattctatcaatgcagaggttttgccagaacccattggagctcttataatttttatttgttcagaaaaggttttaaaatgaaccattgaagcatcttgcaaatacactgaaacgttttgtgcaaagtggcaatccaacaaattttgtccaaaccattccaaaaataattgatcattttgaagctgagtttccatttgacagatccccacaatggcattgagcagagtagatgtgattaatatgagaatttgggtcttaagtataatctgtgcttgtttaacgtatgtcaacgtcacagtgcatttagtggctgttcactttcccaatttgggattcccatgcgcatattatgaaatcaatgatatgaaagccatcaacctctctatacggaatgacatccgcagcctaacgccacaactctacctaaatcctatccaacttatctgctatgttgttttcatggatatctgctttttcttcatcttagtatactatatagtttgttgcgtaaaagtattctcttccgaaaaaactcccaacatcaatcaatctacaagggatataacttggatgggggatagtttatcgtgtttccaatttgttttaactatggatacatatcagttctttgtcacctgtctttcttttcgactagtcaccctcgcagcttttacgtattgcctgtttttcatttgcttcacagctttcacgttgactatgataacacagtatcaatcctctgaaagatctttcttcgtattgaaacggatccacccaaaactcaaaggcacaataaaatataaaactatcataatcaatatgatagaactaatgttgggtttttccagtatggtgtttgcaattacgatttgtctaggtttaggtaacaatttctatattaaatcatcaacagtggctttcgcatctatcaacaccttttttgttatgtcttttgtatactctttggtgattgaattaattttacatcagtatgttaaggttcaatttggtttacattttggaattttgtttggtatcctaggcttaacctacccaatactaaaatatgattcactatttaaaacggaatggactgtcaaattcatagtcaatctagctgtgatcaccatagtttgtctttcctttattatatgcagattaattagattttttatgcggaaacatcataattataagaaattacctacaacagtggaagacctagatgtattagaagaagcaaatgaataaagggtttttaatcaatggacgtttatttggattgattttcaagtttcttctgggttaacgaaacgctagaatcttgtttatttagaagtggcttctctagttgcaactcttcttcagattcagtatcacttaaagcagaaaattctttttcaagattaatatattttcctttatagtctactaaggtgtcttcggccttgctgaagatgccgccatgtattgtcttacagcactttgagcccatatttttaaatttgtctgttgtgcaattttattttcccagatacagcatatatctttgattactcgtgaagtaaattcagcgtcaatagtaattggagtaatcaataaaattaaagggatttcttcttctaaatattctgtgtcctcaattagcaagcgacagtttttttcgtcgtcttctctttttcgaaatatggcagatacaatataaaccgagggtaaattctctttttcaatattttctggattatcgtgatcctgtatataaaattgagtcattacatattgctgtaaaatactctgaaaataatatctatgcctaggatttataaaagcatcaatagtaaaaatagctttttggtatgcaaccaatgtgtttaatatacagtctttaacgacatcaaaaataattgccgttgacacatttttttcgttcatgggaattagtcgtgtaatgtcgaacgtcaaatttttgggagtcaagcaagcacgacgttttttaccagaatcgtatagaggattgttagtgattaaatattctcttgccgagggcatctttccattttctctatactctatagctggtattggatgtgataagatgaatttagctaaagcaatttctgacggattttgtaacagctcggaaacaaatagatcgtttttttctctcagatatttatatctaaatttcaattcaaatataacaactttatcccctacttctatcaggttgttgtcattaaaagagattccataataagaatctatggatgcaccaaacactccagatgaaggatctaataataaaccaagtgttttagatatccagggctttttcacaaagaatgtctttaacaggtgttctatgatgcgttcatgtttaattccatataaaaccgcatctcctaaataagaatgctcctgtatacccgaaaaagatttagagatatagatgtcataaattttagttgccgtgatgcaattttttcgcatagcgtgccagagtggatttgttgactgtcctcttgtctctcgttctaatattttaaatagattcttaacaacttttggactcgcatcttgtaagcggacataaatattgctatataaatcagatagctcaacattctcatcgataaaatctgatatgttttgatgcatataatcaatgaacgatctggctaagaaggtatctttgaagcgagaattaaactttattaagatataataagtataacacagacggataaaattaaatgaaattttccttcttgaaatgtccagattgtttaatttgtctattagaaataaaaagaccgagtcctcttctataatagaagccaaattacaagaaatttgtgcgtaatctattgccatgttacacccgaaatacagaatatggatccttctctaaatctgaaatagttataatggaaagcaattgttgcagatcatttaaaagtatttgaccaatttcgtgtctttgtaattgggcgtgcctatacctgattggttgtcttctaacatctctactgtcatttacatatgtttcctcgagtaaatctcttacgcttaaatcaccacttgcgtgcagaaagtcatacaagttttcaaacatatccaccacctcacgataaaaaagaatgccaaataaaactaagtgctcagctaaaactttgcaacaagcatctttatattctaaagggtatttgattggattcaaagtacaagcttcatttgagtacgtgaacaatcgattttcataatatttttgcgcctcacggcatccgcgttcatccaacattctgatgacacataataaaaatacttgcgctagtgcacaaagatctagattacaatgtctcactggattgcccttaccatcaaattctgcataaacttcgaccaaaattattttgtgagctatcatgggtctgaaacctggattaaacatgtcacacaatttattataacttttaggcacaatctggatcctatgatcaaattgtcttagtattccacattttccattatactgtgggtgtacttcagctaaactgtaatcagctaacacagcctccaaaataataccttccttgtggtgtatcaaaatatttgctagtgaaatatcacaatggttgattttacacaccatgtttaaaaaacgaacagcttctgcaaggttgcaaaaaatagagtaataattttcaacgttttccaatttccagtctgtaaatttatataaatctgtatcataagttttggaaagggagattttatggttcaggcagacagaattacatatcaaaagacttttaaacacgcattcgcgtgaggttaattgagctccggcttttgcacgaactactccagacacataagaagaaatgcagctctctaagtcatcagaagctttaattgcaacattgttcaaatcatataccattccatatgatccgcttcctaaaatccgtgccatgtttttttctggctcgcaaaactgagaacaggaactttccttatgtggaacatagacaactgaaaatgactgagtatcaatgtgtattgaaaacaaaaagggtgaatgaatacgctcaaaaattccaagattacataaaacggggtaatgtgcacttaaatctgtcacagacttttcatttcgacttaacacgattttccttgtatccataaaattctcaaattccgtgcatgcactcaatccatctcgttcaaactttggagatacagtcaaagattcatgacataggaggtctgttacagatggatctggacataagtccgtctcagaccgttttcgtatcatcgagccccgttttttttccaattcgttatccacgtctgaagccagaggtatttttttgttaggtctgatgttttcggaaccaaataatttacgttttactttacaaggcctttttttaagttcttttcctttttttttaggaagcatatttcttggacgtgttttttgattttggggtgtcttaagctgctccatatttagtctgattctaatccggccagtaaagtttcttttatattgtcggtgacggatttcacttccgctgccgtatccaaaatgtcatccaaatctacacattctagctgagcagcatttttcctttgcgctttcagctgcagcttttgatcctttaacatttttgtcaaagaagtaattatctgggactgttcgagattttctgatacaagattttgattgagagcgtgaatttgctgtcgaacgctaagaggatgatcttcaccaagttttaattttaacaactcataatgttttttttctaaatttttggacatagtttgttttattaattcatgcagtgacattatagtttcaaaagtacaccgttctctgaaaaaacaagagctgatagtaatttgcctatatcgtaaactggaaaaattattgcttccttagaacctggcaagatttgagttatggtaactgttgtttgcataaatgtacagtcctttaatattattggactgaacacactcatacttagattgtttgcggcatattccatacagagcctattttgtctatataatgcacaaaacaggcatatttgagccgccaatggaaaatttcctatctcttcctcacaaattctttctttggcccgtaaatctgacagaaccaacttaatacgctttttaataccttgctgtaaatttgaattttcgacactaaaatctctatacaaagagaacacataaatttgcaataacccaaaaaatacactaaggttcatatttctttcatacatgcatggtggaaacaatattgggaaaggggcgttataccccgccttatttagtccaaaacaattatcagcctgacaataactcataggaccacaaaaagctaaccataacaaacattctaaatcacgtacatcggtatgtcctagaagactgggtgtttcagcataacgtaaaatatcctgaacaaaatcagacttatctaacagaaacgccacctcgatgtgttttttcgtatagatgatatatgatccagttagagcgatgttctcactggtcatttttctcacattttgcaacaaatactttttggatgattttacaggtaccgctgtattaaaggaagacgccagtttttccaacgctgcatcaatattaagatttgcttcagtcgttgctttcgaagtttctgatggaacaacatttgttactagtaagaagttattagttggtgtttcaacgagttttagacgtgtattaggagcggttgctttacacacagttagtgcggtctgcactgcctccgagaaaattttagcatccttttcatttaatttagtcgtttctttataaattgcagctagagcaatatctgtgtccatgttgcgatcatgcgatatagatgcaattcagaaagcgtatcagtctataatttggaaacatgaacaggacgtaaagatttcttcaacttttccaaacagcgcgatattttgccaaaaacgatttattatattaactccagaacttggctttacacatgcatattgcaggcatgttaaacctttatatctcttttgtgatcgccaacggcacgtaaaatctaaaattgcaatatgcgaccccttgaactgcgctttgtcaaagctcaaatttactgcaatcatagagaaaaacacagaagtacaatatcaaaaacatctagagctacaaacaagtttttacagaaatcccatgtttttacagatcgaaaaatttattcaagattttcaaagatggatctgcggtgattttgagaacaccaataaaaaggaaagaattaaactagagccatttcaaaagagcattcttatacacataatttttttcatctctgttacgaaattacccacactggccaatcatgtccttgattacttaaaatataaatttgacatagagtttataaacgaaagcagcgtaaacatacttaaacagaaagctagtgtttttctagttcccagaagacacggtaaaacatggttcatgataccagttatttgttttttattaaagaatttagaaggaatcagcattggttatgttgcacatcaaaaacacgtttcgcactttgttatgaaagatgttgaatttaaatgtagacgttttttcccgcaaaagaatatcacctgtcaagataatgtgattactatcgaacacgaaacaataaaaagtacagcactgtttgctagttgttacaacactcacgtaagtaacaaatttttcttacctacttactatgcgtttacagactggacaggaaaggagtattaatctgctaattgctgggtcaagacgaattaatatccagtttgtattccttaaaacgactggttcttgattcttatgtccatgtacgtaagcatttatatcagttgaaagactagtgggcttttcagggtaaattagatcaagtaaatcgagctcttgatcacataataatgaagacagatcttggttggaaatcttagccatttttttcttgcatggggtgtaacaaaaacatgtttcttgattatcagtgcatccaacggttttgccagtttgttctacgtgtttactatgatccttacaaaaaacacaatgtttattattgcaggaaatcatatcaaaaactactttagataatgatggcaaagtgtttttttcaaagcaagccagatataaatcgtacaccaggacaaaagtgtacacataataacgtcccatgttgttgagacaccaagaaccacaacccaaaggaattaatttattttctccaggtcctttaacagttaaaagtttagcttcgtcataactaacaattgaacaagtatcataaattagatttggcgtaataggtcgcacattcagcacatgttcactattgtattttggaatgaaatgtaaatccgttaccgttaaagatcccaattctaatatgtagtacaccaaatcgtttgttattataattttttttagtttaatggaatttgttgcaaactgtccggcatgtattccgtttatggccaagctaaaaacaaaatccaaattcttttttaaaataattatattacagtgcaagcaatctttaaatttatcaacagcgaaaacaggagaagatgttgccacacaacgatattcgtggtacaacttttttttacacaccgaaaaccaattacactcattttgtaaaaaactcctaagacatcccaaattgccaatcgaagaaaaattcatcgttctcttttaatttaaaagttccagacacgcagaaccccccgggtaatacccaatacagctttaaattctcagacatatatagtgcataacaattaggctgtaattcccatgaaatgttttgattttttctgaatgtggagtataagctcgtttcagaatttaattgccaccgtactttctctccatataaggtttttcccgtagtgcaatcaattaagtcagcccaaaattcattcgaactaagtgagcttctccctttttttttatgaagaaaatgactggccatagcttttaaaacacaactatttctatctaaagacaaaatccaaaaatccctcgccaattccataccagaaattaagtgagtacaattaaactctatttgaaaatgactattaaatttttgtggaagatgtctattctgaatttccatgttagtagtaatacatcgaaaagttctttcagcaatctcgtctagatatgtgttgactctatctaaataattcgttattgatgaaaacaaattttcaggaggaatttgaatatttttaatttgcatttgtatccctttcgataactcataccaaaaaatgacaagcacatgtctttgttgaatgtcagatatgaagtcacactttagattttggctgtaccacgaatcacttagaaaggttacgttcgctttttcaggccttgatattggatgactatgcctaacgttcgcagattgttttaatcctctaacagttgatggaggttctaacggaccatgatggttgaacgaaatagggtcttcctttgtgagatctccaagttttgcaggaatatggaaaaaaggtttttccacctcttgttttttttccactgttttttgcatgcgaggtgctccagacaaaatttccgataattttatgacaatatcatcgtgcaaaaaatgtgggtaaataatttttagaattaaaatatctgtatcaaaatgtaggttatcaatatttatgggaactgaaagaattaatgccccatgtattacttctttaatacaggcattcttaaagatttgagaaattacaagatcatgtaacacataagtaaactttatttttgtccattccgtatatacaagcttttctttaaaaaatacacactgaaaaaagatcccttctatagcttttactttctctttatgtataacatcatccagtaaaatacataaatgtaccggtaaaatattattttttctgcaagtaaacattgtttcacagagcaagtgcatttccatattcaatcctcatttttttaagtatgttatcctccctctttcttctactaacacgaatgacattattatcgtaaatagtgccttccgcgtggcctccaattattaactgaacaaaaagttgactgacagtagtaagaggtaacttattcaaggtggagttcttaaacaccttattaaatgtacaaaaaacagcattttctacttgttctataaactttccatcttttataatgtcgcgaataatgtttgaatacctggctttattttgtattaaaaaactgtaaacgtatgataacagcactacaactacattaacggtctccatatttggctcttcagtaggttccatacaggtatgtgaataggctggcatccatccgttataaaaaagcccggtttttgaacacacgcatccttcatgagtatttatcaggttgcagtcttctagcatattgcaaaaatgtatcttaaaacaccgaacacatataaagatgtttcccaaacccatttcaaatgtcagaggattatgcaaattgtacatttgcgaacattctccttcacaagcaactgtgattgactgacatttaggcaagtccatcttttttttgttcattatattttaaaagatcgttaaaaatttccaccgcgagcgtatcatacatcaccgcaaccaactcggtttttttaggaaaagattctaccggttcaagaatgaaatcacagttcagacaaattttttgtatcaacgttaaaagatctgttttagtattacataaaaactcagtctttatatcgtttaaaactccgttcattttcttctcagagtatacgtggtcagagctttaatcttctcatcgttgatgaaagccattttatcaaaaaagacgcgtttagcacaattcttggatttctgccacaatcttcgactaaaattatttttatatcatccacaaattccggaaatcactctacttccttcttgacaaaactaagcaattccccctttgaaatgttaactgtagtatcttatgtttgtgaagatcatgtgcacatactaaatgacagaggaaatgcaacaacctgtgcatgttaccgactacataaaccgaaatttatcagcatcaacgctgacgtcaaaaaaaccgccgacctatttttagaaggtgctttcaaacacgaaataatgggtggttctctctgcaatgtggtaaatgataccttgataacagagcaaggactcattgaattcgaccttttccgatatagcacaattagcaaacagataattccattcttaggcaaagagctctacatatatattgatccagcatacacaatcaatcgacgtgcttctggaacaggggtagcagcgatcggaacatatggtgatcaatatataatatatggaatggagcactattttctagaaagtttactatcaaactccgatgcttcaattgctgaatgtgcctcacatatgatactagctgttttagaattacaccctttttttactgagctcaaaattattatcgagggtaattccaatcaatcatcggcggtgaaaattgcatgcatattgaaacaaactatatcggttataagatataagcacataacatttttccatactttagatcagagccaaattgcacaaccattttatttactggggagagaaaagagattagccgtagaatatttcatttcgaattttaattcaggttacattaaagcgtcacaagaactaatttcctttacaataaaaataacgtatgacccaatagagtatgtgattgaacaaattaagaatcttcaccaaattaatataaatgaacacgtaacctataatgccaaaaaacaaacctgttcagatgaccttttaatttctattataatggctatttatatgtgccatgaaggtaaacaaacttcatttaaagaaatctaaagtcccaaacaggcatttaagaatttaatcatatcttgcttagatgctgaaacatcaattttaatgtgcttatttatatatggcaataaatctgtaaaatttaaatactgagagaataagttcatcatgtttgttgagtacgaaagaattttgtaagaaacatctatgtgctctgaataatatgctttcactactacatgaatggatctggtattgtctacaatttctggcaataaagttttgtaactataaatggaatttaacaaagtgcataaataataacaattatagaaacattcctcatggccagtgaatgattttgacattagttctggccgttgacgtaattttccattcatttcctcccaaaaattaacagctccaagcttaaataagcaggcatggactaatataaaattttgcaacacagtaccatttgtcaaagtatatctttgtgattcagcaagctttttgcatgttttgacaatatcattctcgctttttgaggttatggtcgcctcttcggcaactaacttccaaatacatgacaccatttccttaaatcggggtgcttcttcaatctctaaaaggattgacggcttgtgtgctattttgggaaaaatctcattttgatttggagacagagcactttttatagtctttgtttttattaaagatttccaccttaattcagttggtgctaaattttctcgaagtaaaaacagtttgggcttttcatacaaaatgttattgtccgtggatttaattccacattcaatagaaatcttttcacagtgtataattccagttaaagcataaattacttcactgtaagcatgccaatatatcgtgatgctggaaatattctgatttatacatccagtaatgtaaacacataggtctgtcatagatacaaattccgtctttaactgtaacagttcacttaaatcggaattcaagatttcatgcacagttgctgtctcattgttaacgtaaagtgtacagtctttccaaactggaaaaatttgttttgctgtcattgtgcatcaagttgagtaaacgattactttcagtttgaacatgagcattaaaagatgtagtagctaaatacttcaaaagtttgcgaaaaattgtcttccttttataataaccattttctacaataaaacgtaaaacggttaaagcgtttgcgtttcgacccaaatgatccagtttcatttttttctgcttagacagaatttttggcacattgttggcaagtcgacttccaactagagcgcatgcatgtttaattttactgttggcaactgaattcttcgaaaaatcgaaaaaacccttttgtattaagaatagcataatgtgatggacctttctttcctgtttacgtccatatcccactaaaagacctaaacgaagaaacataaaaaattgtttaataagaaatggaacctgatgcatatttcgtttctctaaaagagttaacaaagcatgtaaatccatatcaaaagtaatattgggaatttctccgatgcttatgagttctttcaaaagaacattttttaagtctgttccagaaaccttgggtattatgcctgttcccgctttaaaccaaccaacattaactttttcagaattggagatcatacaaggaaaattagttatccagtaaaccttctttttacgctttcgcacaattccttgattttctagcccatgcaaatccatcgaattattactgttacaaacaaaagcaggtaaaaaaaaatcttgtatgttaacatgtaatctatacacacccaatgcatataaaaaatcacagtagggacctcgaatgttaatgttcaatgaacttgtggtgaaatcatcatttgaaatgaaggtactcactgttaaagagggttctttaaaagtgcgcttatacatcacaaaactatgtgtcatgcttttaggaatacgatgtaaaacacagtgtatttctcctgaaagagcagctttcacattcatgaccctatttgtattaaatgcattcacagttgtttctccatgcgtgaccgatgtgatttctgcgaaatcatttccacctggaataaactgcaaagttttctcttggtaactcggaatttcaaagctaaattgttgattaatttcgcgaaaactttttagagacaatctttccaatattcgtatgtaatgcatcgacaacaaactctcttcttgtgtttgttttacattgtcttttaaattgtaaccatagtaaattaacaataaatttctccaaacaagttgcttttcatccagtgtatataaagttttaccatgataaaaactattagaaatggataattttgtgtttttcataattttcaaatttagatataaggtctggagtttgaatttcaatgaacaaaaactttgaataccaggagtgatttgcgcagacaatttaaatgttcgtagaacaaaatatttgtcctctgcaaatttagcggtaatgacattgaaaaaatctgctgttgtactgttgtgcttactaacggaatagtagagtttttggatttcaagggtaaaaacctgttctaacaaagaaacagtgaaattcattggtttagatcgaaacccgaataacagtttatagtgaattataatcctttgagaagtctttggaccaagaaaagctatcaattcattagtacattgctcaatatcaatgatagacagatgcttgcatagatagcatagaaaatacggataatattccaagtaaattgaagcattgtttggaaagattgttgcagtatatttatcacctgttacgttcgaacaagtacataagatatttgatagatgactattccattcttgtaatgataataatcctctaaagatgtgagtggaatgataattagtcatgatagaaaaacgatatgtgctttcacagcattgagaagcatttttatagatatatagaaccgggccttcgcaattataactacattttgtcagataaaaattgacatcccattcttcgcagtagcacggaatactcacaggaccaagcagtaaacgacacaaagcaaactttgcctgatcttttacattttcaacgctaggaccagacgcagaaaaaattgattctataacttcatctattttctctaatgaaatttgaacttgtcgcgctaatcgcacgtcttcatttttggccacttctgcggttaaatcataggagttaataaacactggaacatttttagcacagtgattaacggtgtagctctttactattaaagtttcttcagatattgagtctatcattattactaaccatggaaaattggcgcacagctgaaattttcccaaaactagatgtttctccaaacgtgtttgatgatatcagaacacaaactgctgaacaactttttgaaaacttaagattgtattacggtgacgactctgatcgttataacataagtttcgaagcattacttgggatttactgtaatcggactgaatggatagatttttttcatacgtccatagcggttgctgcaaatgttatccgtttcaacgacctagacaaaatgtcactgggaaaaattctgttttatatacaattacctagagtcgctacaggaaacgacgtaactgcgcctaaagaaacaaccgtactggttaccaagtattcagaaaagcatcctatcaatatatcgtttgaattaagtgctgcttgtttagcgcatttagaaaacacctttaaaaacacaattttagatcaaatgctcaacatcaatgcgattcatacggtgttacgatcgctgaagaattctgctgattcgttacaacgagggttaatatatgctttcattaaaactattcttaagaaggcaccgccacagtttatcctgaaaaccatgttagaaaacaaagtcaacagtaaacagattctttctaaagtacagcgaagcaatatgtttcaaaactttaaaaacaaactcatcaattccttattttttttgaacagaacttctaatgtaagctttatatacagatatctgtgtgaaatggttgattcaaccactgaaagcattttaaataacaccaatagctatgtcttaaaagatggaacacctattaacggcgttttactcggaactcctaatacgattcagattttgtccaacgccctatcgcaacacatttcacaaatgacaatgtctgtacctgtttcttatggcacatttgttatggggaaagaaaatgctgttactgcaatagcataccaggctattatggcggatttttcaaattataccaaaaacgttgcgactgaaacacaagaccaaaacaaaaaatctgaaatctttgaaaaccaaactcaacatgctgatctaaagacaaacattattcaactgagtgataaaacagttgtcttagatcatttaaagaaagtgtataaaaacactaacattgaggatcctttggaacaaaaattggaattgacgttttttttcccaatgggcttatacatttcgaaggatagtggttttagcactatggatagcaggcttaaactaaatgatacaatggaaaacaatctacccacatctatctatttctataataaggataagcttttgcagagaatagactatagtgatctattgccatcattatgccatccaattatttttgattgtagtgtctcagagcgaatttttaaaaatgctgcaaaacctacgggggaatcttttaaccaactgtgtcaggttgaatttgttagagaacctccaagcacctttttatcaaatttatacaacttatatgaaatgaaaaaagaaatacctaagacgacgaatatgcttaaaaatgaacttaccacagaagatttctataaatctgaaaattttactttaaagacagagctacatccattttttgatttcacctatattcaaaaaaacagatcaactgatgttttgtgttcaccaagaattttgttaggcaatatacctctgcctttagcaccttcatcttttcatgaagctaggaccaatcaaatgatcgaacaagccaagacaaataatttaaattatgactacaccctgaaactcgtcgttgaaagtttaactaacacagcttatcccgaactagcatatatcatagaacttctcatccatggtaataagacagcgtttcagattcttaaagacgttgtcagccaatgtattacgtattggtataatataaagcacatattattgttttgcaataattttgaaatgatttggttaattacaacctatcttggagatgagtcaattccaggaattgcttatacacattacaaaaatataatttcaatcttaaaattagtgaaaaggacaatttctatttcaaactttaatgagcaactgtgtggggaaccattggttggatttgtgaacgctttgtttgataatcgtctattccctccatttctaaacagtcttccaaaaaatgaagcaaatgcaataatcacagctggtaacactccccttacccaaaatacagtgaaattaagaaactatgaagtatctgacctgaatagaatgaatttattggattcaacagaaatcttcacagacgtagatagaccatcttttgaaacaattgttttaagcaaaattttttatttctgctttctaccagcactgacaaataacaagatgtgtggtgcaggttttgatgtgaaatctttcattctagatttcttctacacagaaccctttatattacctgatgacaacttttgcgaattaccgattacgaacaatgtattgattgaattgataactgaagctgttggtccctcacatgcactcacagatttatcttgcattggtaaacaactctttaaatctatattatacctaacggagaatacaaaaattttggaaattgaatcttctttagatccttctcaaagacatggtagttcttcaaacttcaaatctctacaacatgttttatataatggactgtgtttagtatcaccaattaatgtgttgaaacggtatttcaagccaattccttttaatcgttttttctcagaccctattatttgtggcttaatgaatattgaagtacaaacctatctaaacatatttccccactatcaaagaaatgacggtggttttcctctaccacaagcattatctcatgaattccataattggcaaagaacaccgttctttgtctatgcttcttgttgttcaaattcattgctaagtatcatgactttagctactatgcattgcaaattgtctccaatagctatcattcttcaaagcagacaaaaaattcatcctggtttcgctgcgactttagtaagaacagattgtttcgacattaattgcttactgtatagctccaaatctgcaacatccataatgattgatgacccaacggtatctacagaagtaaaagacatctcaaccacatataaccttacgcagcatataagttttcttgatatgggattaggatttagttccagcactgcaatcgcaaatttgaaaagggtaaaaactgatatgggaagtaaagtgcaagatctattttcggtctttccaatgcacgcatacaccaaccctactgtaaatagttgggttaggcatcacgttggcattgaaaaacccaatccttccgaaaccgatgctttaaacatcctttctttcggtaagataaataagcaatcacaatcaatacttttacatggccaacaagcaatctgcgaggttgtcattactccagtgacttccgatattaatttctataaaacacctaaaaatcctagaggaagggcttcgtgtatgatgggtgtcgatccccataatgagtcagaagctagaaaatctttgtatgatcattctcgagttgatagcgatgcttttgtggcaacaacaaatccttgggcatctcaagaaggatctttatctgatgtcttatataatataaatcacagagatcaattaggatataatccaaaaagttacagtcctaacgcagtctttttcacagacactgaaatatttaagacaaataagtttatgtttaaacttatcagtgattattccataaaaactaaaacatgcctggacagcgacactgatattcagtattcttgttccgaaggaacagacgatgtcactcatcgtccttgtcagtttttacaaattgcgtttccaatccattgctcctctaaccaagctctattagagagtcgatctaagaacggaatgacacagttaagtgaaacgcattttgcaaatttcgctataggggagtgtattccgttacaaaatattattgagtccctgctatagaaatggattcaatctactgtacttttgatcaaaagcttactctttctgacattggaactttatgcaaactcactaatgccgtcatcccaataccgtcgcaccgtcatttaattggcaacacaaatttaggactttacacggtcttatctacaaccaccgattatattcaaataagggatatcttaaaaacaatggtgttaacaatcttacaaaaagtagaaggaaaccaattaatattaatacgtccaaaaattggacaccagtatgaaatcaaaaataccggaccatttcctctggaaaagggagatcaattgagtttactgccaccatttctgaaaccttcgcaacaattacttgtcttacctaactgggagctgattctgccattactgatccctacagacgtcgcaacggaaataaacgtgcgaatgctttgcatcagcctcctttccatacatagaaaatatgaagaagttcaaataattatagatgagctgcgcactttgcagtacagagatgtaacaattaagttaccagatgttatcaatgattgtaagtccacgttttccatgaaaacagcatgcatttctttttctatgattgccaccatggctcctgatatagttcaaacatatatagaaagattatctttagaagatcagtctatgttattgattaaatgtcaagaactcctagcaaaaaaaaatttttctcaagaacctagttctttcaaggccactgaaattaaaacagaattacagaaaattaaaacggttttcaccatgattaaccaaatcaattcccttacacaagaaaaaacgtttttcattgtggctgatgtttctgctgacaataggctggcaacttgtatatttaaagagtgaataaaaagttctttgaaatagtgtctgttgtaacagattttatttcagctccatgtctctcgcaacttctgatatcttaaaatatgttcagattgaaattccatacaaagaagaattccagggtaaagataatgttacattattatttgacgagtatgtccaatcaaaaactgaaccagttttacttttgagcgctgaaataaattcaaggaattctgactcctttttttctgctcgtcctttaatggaagaacaacaactaaaactacatttaaaaaatctgaatagacacatttatccatcaaaagtcttgttttttggatttccgttgttaaaaattaacagctctatcgtcatcatcccaaaccatgatgttaaagaacaagagcagatgggagtttttcctagtctgataagattcaaaaacgaaaaggtcatagtgacgcaaaccccacataaagtaaacgaaataaccgtcacgatgtttaacattgaatggaaactaagtacttatcaacgttcgattgaaagaacacctggccatccattaacaactctatgtacagtctgctctgttaacataaacaatttacctttttggtttcacgatgttcggagtggttcagattttccaacgtgcaaagtgttttctatttcagacccaacagtttccgtacttaaaatgatcttttctcctcctctactcgaaatctatcttcgatgttatacagaggtaactaaaaataacacgtatatggttccaaacgattgcatgcttaaacttggttttgtcaacgaaataatcccaaacgaaatttctctaactgtgcatatgcattactttaaaatctgtagcgataaaagaaaaattgacgtttttttccaagacacgatgcttttcgatgagggcgaaactaaaaaacttcattttaaaggcactttttataattttaatgctaatgctctctacgttccagacccaaattccaaagtgcagtctattgcttctttctggtctcccactacaagttttaccacaaaagtgactagtgatagatcgcagagagtgactacaaatgacataataggcagcatttattttatcccaacgcatattttacgaactaaatttgatcccaactatacggatagttttgctgctgaaattgagcttaactcagaagatccagaatctgacgcactgtattttttagcagacaaaatttttatctctgatttgccagatttaatcttaagaaaaggttggagcgctcgtaaaaaaaaattgcaatctggatcaaatataaataaccacgccccttcaaaaagtagattgcggttttaaaaagccttagaagcttgctagattctataaaacgtgtgaaaacaattaagaatcatttgtatattctagttttctttgtaaaaatgaattcaacaccagtctctgaattatcgcaattaattcagtttactgtggattttaatgatttgcagccagaactcaatttttctcccgcagagattacctgcatactttcgcacgaaagacctgtactgttgctaattaccgatggaactgaaaacaatgcagaatgcgtaactttggtgggtcacgttctaaaaaacaaaaaagtgatcaaaattaatgtttttcctatgatacaatcgataaactttgtcaatatttttgccctgccaatttttaacattacgtcatccctgctgatacaagataattgttactttaaagaaaatatggatcctcttagatttcatcaatttgcctatcttgaaaagggtttaggaacaactcctataattttatattctgtgaaaaatggtgatctgatcgtaaatgccacagtaactaaaattacttgggaaaagaatgaatttcaacctttactgaaaaactccaatgatcaaaaactggaaaccatgtactgcatcttcaccttcaatacaacatactgcaaatattggaatgtttttttcgcgagcgcaacgccaatctgcaacgtggaaatgatatcagaacacaatctttcggtgtacaagattgaatatcgatcaccggtgttatttgtctttctacggtatcttaaagtaatgaattcacgtttctgtgtggatgagtgttctttacgcttaagactttctaaaccaaatatgcaatcagttgcacttaacatttgcatgccgtatttcaatatttctgaagaattcaaaacaatggaaatttatttccctgaaagaatgacactgacacctaatcacatcacacaaatcaatttacgaggaacctttgagaatcctgctgctgtagggctattcattccaaagaaatctaatgtactctcatttcctttcatttggcaaccgcgtgagacttttagaatttacgtgtactgccgaaatgagacatttgtaacggagcatgatataattggtcatgtctactttatcagtagagaacaatttccacattctttccatcctacagcacacgcagattgcaaatcaaaagttgaagccgctttcaattcatttcgaattaactttttagggaacgattttttttcagactctctcccaattttgacagttcatcccatgacagactttccctacgaacaaatacaagagacagaaaacattagacataactctatgaacataacaccccgcttcaaacgtatgcaattgtaatatcaactatttaagtattttacaacaataaaagatttaaagtaagaatggaatcctgttatgtggtctggtcttcatattttctacaactaaaattgacagcaccaatccttttaaaacctcgtgaaataagatgcttaaggacagggctaagcatactttcgcaacaatcaacatttgtgtgtatgtgcagagatgaaggaagctttacagcagcctactttacgtatatcgatctaagagattgtggcaatgtaaccttggctgttcaaaatatatctgatgtagatttagatttaaaacaatttcctttaattattaatctttttgccttttttcttcctagcattaatttggtatcacttcctgtccaaatagttgagcgcatggagcacaattacattccacatggagagtgccgtgctcaatttattctttatggatctcaaactaaattaagagcccatattaagagaatacgctggacagaattacaacacgaagaaccaacgcattacatgtacgcgtgtgaattttggatagatttacaaacaactccaccagatcaaatttttaacagtgcaaaagtggaatttatatccagcagaaatgtttattttaagcaaataatgctgcatgaaaaaatccttgttataagagcatcttatgaaaacaattatcttttaaatcctgataattttcctagcgacatctttttccaagtaaattttatccaaaccattcctcacattgtgatggaaagaaatcaagaacctgtaatgacgtacgatggcacatgcataaccgtaggttctacaaaaaacattaattcgaataccactgaccccttctcatgtacatttccaacattttttgattctaaacagaaatttgcaggactttttattccgagattaataaacgggatttcattaaacactttcacttggaaagagagaactcatcttcaagtaaccatgagagcctacaaaaaaaactgccgtattgattattctcaggaactgggaaaacttattttcctacccagtcaaatagtaacacacgatcaatcaaatatagattttggctggacagagacaagcagaattttgatttccaatcaaaataatcaaataagtgtctttagatcggaaacaacacctgtcgctgatagtcctgtactatctacagtaccaaatatcacagctgcaactaacgtatctattaatctaaattctcttcatttaaacatagctaaggaacaccttgtaccagtcagatatcgcatgagaacagacaaccttcgcacatttctaccaatcactgccttaccacacacattaactgttttagaaggcaacattgggctgcaaacggttccttgtcccagtgggaacagagacattaacgcataatttgtattcaattgtccattttattcaaagcttctacaaacaattttttgttcaaactcaataaagattgatcactttgcatcaaattttgattcctgtcttgacctggagttagcgaggcatttacaaccgatggtttaggtgatgccacgtttttttcttcaatcgttggcattgtatctaccgctgtacaatgctgtctctgaggagactgagaccgaatatactttagcgctgaaatttcatgacgcagcatccctattgcatcaactagttctttaatatcatttttgtctttagtgagttcacgatcgtcatcttctctataccgcttctttttctttgtcgtatagtcaggatctcctggaaagctcatttcatcatccgaatctgttggagcgcaccgtttttgggaaccacgataagatttataattaaatccaggcatagagggataccaatatggaggtggtatgtgataattcattctatttccataatccactctgctcagagattctgggtacggagttatatattcatcagttttaaatatcggagcagctggcgttacgtttttattttgggccccagctgtagcattcagtaaggagcaaaatgtatctttcggtaaaaaaacacattcggaaaactgaggagcgggaagactagctgagttgccagtagctgagccattcattctgactaggtcgtgatgcgttgtgtgcgttgtcgagcaaatcgtacttatcaaatctggtgcatggactgcgcaatcatcttgtgaaacgctgtctgttgcttctgtctcctttgtgacttttgaattcacgttaatagtatggttgttagccgttaaattttcactcgctttaatataagtagattttgaaattccactaagttgcttatcagactgtaattttggaaaacgtacttttatgtacgaagtgtctaaactatccgctagcagatcatataaatccactttaaattgttcctcggcaaaaaactgaacacagctttgatctgtgctcagaatcttttctttttccgcttctgtaatagaagaaaatctatccagaatccaatttaaatttcgtccaaaaatagctattgttccaggtcgacgaccaacgccacagatagagacatgtttaaaaaacggatcacgttcattgccaccaaccctgttcgataatgacaaacctgggaaaattgaatttaaacactctatttcgggatctggtggcagagttttttcttccgtgttggttatcagcttagattttgcagctattttcttaattattgtaaggaattcctttgattgaacacgggcaacgaaacaaaccgtgctgtaaacacttaaagaagagactgtgcctataacggcattttcattgtggtttatattcaatggaatattcaaaccatttccggaattgatttcttcttgtatcgtcctccttggcagataaaagttatcatttatatcattatcatcatacacacataggaagcctgccactagcacagtttccattattacgatgacacaagtaggtcaatacataatctcgaacaactcaacctccaatttaatattacatatcactaagaaattggtaagcggtgaatctttatttaatctaaaacaagaagagattttgatcatccagaatgtgtgtaccctaatgttttctcacggcatccaaatcttactgttgagagagactttgcacaatatcggagtgagtgatttagtggttctgaatcgaaaggtacctgatgaattttggtttaagatcttttgcatgattaaacaaagatctggatcagaaatccttaaacatatcttcagtgaagaaaatgcagctcagctctcgaaaaaattacatcatactggaattgttaaacaaatcatagaaagtttctttttggatgaatttggtctttcaattacaattccagctgaaattattcacgatgggaatataatgttttctattggtgccatctacaatcaccgtttattaaaattatgtcgctatttcaacaagttctgggggcaagaagtatatgaaccttttatccgaaaaatttgtaagcatctgtggtttggttatttaattttttttgacaagatcaaaatttctcacggtgcttttagtcaacagaaaccagaacacaggaatggattatttacttttattcagaatgatttcaaagttttttgtggcatagtggagaaagaagcaaaagtaacagagtgtaatttatcagatttgttttctattggacctctacaattttaaaactgtgtagattttgtaggttgttgcaattttcttaacgaaggcatcaagaaacaaggtttaaaacatttacaaaaaaaagctttggcagctagcctataattctcacagcttattatatatgtcatagtgggaacataaaaaatttttagctctaaacaaacaatgagcaattcatgcagaccgtaaaacaatcgattgcagttgaattcgttaagcaccgaagcagggaaaaagcataaagcaccaaaaaataaaaacaagcttaaatgtgtaacaattgagttcaggtctctttctaaaaagagaaatcgcttatttaacacgtagaaaaaaacaatgaaagttgggatgacaacggtatacattaataagatccaggcttcttctgcagagcgttcaatagccaataaacagtaatcatcttctaaattcatttgcgatttcttatatttcattgaaatttgtacagcttgaaagatggaagtaacccagataattgggaaagacatttgttttagaattttagtttcgtttaccttaatctcagaaaaagaaaaattgttgatacgttccagtgccaacagtgttaacgcccaggacgaaaagataaatgaaaaatcactcagaaacattaagattatacagtaatcggtggatacatcccacattttggttaacattcccattttaaccggtaacaataaaatataaaccaacattccagaaaaagtactaaatgtgtattctcgaccaacggtgctgttattaaatttcaccactattattaccagcagacaaagaaagaaaaacgagaaaaaaaacagatattcatatatttctgccagtaatttccaatttgttaaatcgatatttttcatgtttacaaaagcttaagaaaggtgtcttttttaaaatgaagctccttaacacttccacgcgtatttatatccaaaacaaatgtctagacgtcacctggtcttcaaataacagttgctactggaataaaacctaataccaaaaaatacaagaaatcatacaaatcagccacattaaataatgaggatgccatagcgaacaacctatgtcgtggaagtgctaatgagagtgtcacattcaagccattttcaaaatgaaaaagaattttatcatgtttctcgagtaccgcaagttctgccgtttcttctaattgtgaacggatatattcaacaaacggattgtcttttgtttggctatgcaaagcattagtttgtgttaaagtattttgattatgatcccagcctaaacgaacactttcgttaactacgatgctgattaaccccggaaataaagtggaaatagtactttcattattggctaaatatgtggggacgacatagtttttcatgagaaactcaaaattctggatattgacagaagaaaattctgtttctgtaacatcttctgcatttacatgggggaaaattgttgttagataaaatttcccagttctctttccaaaaatgctttctgagtttagaatttgccaaagtaaatataaggattctatggcaacaattccagaacgcaaatactgctgctgatggacaaatatcggcacctcttttcccaatttcggttgcaataaaatttgagtccaatataataatttatcatctgttaacgtgcctgtcaacttcgattctattacaacatgtcctttcgacatttgatctccgggaacttgctttatcacacctttttttataaaaattttaattaagatatgattactgaatgtatttattgcataatgcctccctttacacaacggaataaaatatttcattttgtctggatcattgaatccaaaataaaaatcctgtggtgacgcgtttttcgtagctaaaatttcggtgtttagatatctaaaaatttgagacaaattttgaatgacatccacgaatttaatattttcggttaagaaagttccaggatacgatgcaaaaaaagcagtcagtagacacaaaccagcttctaaatcggacactaaattatcatgcataggataaatagtaatttgttccaatgcattaattgaaatagacagcaattcctgtgtaatagagagagaatcaacatatgttaactttagcattctttttaatttagaatcggtaaagaaagctcgctttaatttgtaaaaccaagctccaaacgtatagctccacatctgagtattattataaaaagtttttatcatctcaggtcggaaattttccgtgaaatgaatagcaggatcaatttgtgtaattgtgacttgcgtgacagttttagcctggagagactcttccaagacagaatgtgtttcactagaaggaattattttttgattttctaaaagcaatgcattttcaatgtctcttaaatttgtatttaatttctggcattctgtctgtacatgtgcttgcaaaacatcaagttcagtttttaacaagttttttaaaatcttgtttttttgaatttcttctttttcttttcgaagttttcgaattcccaagttttggagttgttgcatatcttcctcggtacaaattagagtatttctgacatgcccttcgaaaattggttggattggaaattgataaaatagacttaactgtgtcattttgatatttcgtaaaaaggttgcaaagaaacgtggaagacagttgcaattctttagctatgaaagttttcacaaagtccaattttaaaccatgctgtctaaaaaagcagattacagggtttaccttacataagctttcatttttgatgacaaattgctgtagataatctgttgcttgtcgtagttgccttagtccctgtaaatattgaattttttgtgtcctatttttttgaattgaaaacagatttgatttggcaaaagtagttttgaattcaaaaaaataacaatggaaagtttttaataatttctcaccaaaatgcctaaaaacaataatgcaatccggaatacggcaccctaatctaacttcaaaatatacatgtatttttgaatcatgcagttcttctggaaaaagattgcccaaaaaaaaatttaatttttcaaaattggattttaacaacagaatttttttgtagattctcaaatgattatattgaccaatacgtcttctaacagggggcaagtattctaaagacatattacccaaaatatctctatgattcctatcccgttatgtatttaatatgtaaagtttaaggcgtagcctacaacaaacttcccgtttatcttccaggctctaaattggagaaaatgtatttttacataaatagtctacttctcatcgtgtcaataaatggatggaaacactggaatatactcaattcttcaatttgcgtaaatgaaaaaacaaatcaaactattattcaacctggtttaataacgtttaatttccatgattataacgaaactcgggtttatcagattcccaaatgcttattcggatatacttttgtctcgaatttatttgattctgtgaatttcgatgaatcatttgatcaatataaacatcggattacacgtttttttaacccatcaacagagaaagctgtgaaaatctatgcacaaaaatttcagacaaatatcaaacctgtttcgcatacaaaaacgattacagtgtctttcttacctttattttatgaaaaggatgtctactttgcaaatgtttcggaaattcgcaaactctattacaaccaatacatttgcacactttcaaatggcttgactgattatctattcccaataacagaaagatgtgttatgagacattataattacttaaatactgtgttcatgctagctttgacaccatcgttttttataatttcagtggaaacaggaatggatgatgtcgtttttatctttggaaatgttagtcgtattttttttaaagcaccttttcgaaaaagttcattcatatatagacagactgtctcagacgatctcctgttaattacaaaaaaaacaacaattgaaagattttatccgtttctcaaaatagactttctggatgatatttggaaacaaaattatgacatctcgtttttaatagccaaattcaataagttagcaactgtttatatcatggagggattttgcggaaaaccagttaacaaagacacattccatttaatgtttttattcggcttaactcattttctatatagtactcgaggagatggactcctccctctgttggaaatccttaatactcaccaaagcatcattacgatgggtaggtttttagaaaagtgcttcaaaatgactaagagtcatttattatatcctgagatggaaaaacttcagaatttccagttagtagattattcttatattacatctgatctgacaattcctatctctgctaagctagcatttttatctttagcagatggaagaatcgttacagttccacaaaacaaatggaaagaaatagaaaacaatattgaaacattatatgaaaaacataaattgtttacaaatttaacccaaccggaacgtgcaaatttgtttttactctcagaaattggaaacagtctagtcttccaagaaaagatcaagcgaaagattcatgttttgctcgcaagtctgtgcaatcctttggaaatgtatttttggacacatatgcttgataatgtcatggacattgaaacgatgttttctccttgtgcaacagccacgcgcaaagatttaactcaaagagttgtcaacaacattttatcctataaaaacctagacgcatacacaaacaaggtgatgaacacactttctgtatatagaaaaaagagattagatatgtttaaaagcatttcctgtgtttcaaatgaacaagctgccttcctcacattaccaaatattacttacaccatctcttcaaaatatattttagccggtactagtttcagtgtcacgagtactgtcataagcactacaattattatcactgttgttcccttaaactctacctgcacacctactaattataaatattcggtgaaaaatataaaaccaatctataatatttcatcccacgattgtgtgttttgtgaaagcttggttgtggaatatgacgacatagacggaattatccaatttgtatacataatggatgacaagcaactattaaaattaatagatccggacacaaattttatcgatgtgaatccacgaacacattatttattgtttttaagaaatggctctgttttcgaaattaccgcattagatctaaaatcaagtcaagtttcaatcatgttagttcttctgtatttaattatcataattatagttttgtttggtatttatcatgtatttagattgttttgatattatgctggaacatgagataaacttttattcagacaagtaaaagctagttgtgattgcgaccaaagatcgttgttaaatccaattagagaacgaagaattaataaaagtatcattaaaatgattagcgcgtgaacaaatactgtccaacacaaggtacattttgcaatcatgatcctggttaaaaaaatgaataactattttaggatattgacagttcctaaataattcacatttatgaaaaacaaaatgtattcaatgctagtgttcacgttgatttcttttcttttttatagttatctgatcatatggactcctgtattaagtgtttgctctgaaaaaatctcgtttgtaaatttaacgaatttttccatgtggccgaaattcgcaaaatttcattatgagtcttttgaaaaaacatatattcagagttgcgacatacccatctctaagaactgttttaaacagattttattttggtcattccgtctatcccagaaaaagaatatttgcctttctaaaataaatatgctctatctagataattttccgcgatggacattacattttgaatttcccactaaaacaaacagaaaacgtcacgtttacttagataatatttcctttttgtatttagtttttgctacactagcattcaaaacgatggatgactcttgtgtcaataaaataccgtttgaagtacttgcttcacatttgtttaaaattaactttagccaaaacaagattgaaaccattttccaagatctccaaaaccatactgaagctcaattattttcacgcgaaaattctgagcaacttttttcttttacgaattttatttactactttgtttacaatcgaacagattgcaagaattctatttcaaaatttttctataattctgtgaacacgcggaatgtgtcaacaccatttggtgttaccaacttctccttggtaaggggaatcatgtcaccaatacaaagttttaaggggaacttgatgttcttagaaaataagaccaaagttactaagcctacagcaattccgaacgctgttacttccgaaccaacaaaattttttccatctactcgaggcacctcaagcatgcaagcttcacaacagacttcatcatttcctacgacctttttcacgacaaaccatagtaacacaagcacataaatcagcaaaacacggacttataacttcgtagtgtagagtatctccgtgacaaagcatactttaaaactttgatttgagaaattacagtacaaccgccattcttttcaatgcaactttaattaacactcaaaacagaacttttgtaggaaattttcatagcactcatactaatagaaaaatgtacaataatttctattaagcgttcgtaacaaattcaaccacagacacaccattgttcaacttcaacatacagcatgacgtgatgatggaaagcaaaagccacagatattctaacaaataccatgaaaaatatgagtgtggtgacagaagtaacgcagactaatcacgagaaaaatatttggcttagaatatttatgttcaaatatgcatggagaaaaatacattaaaacagttctgagggcattttcatacattcttcatatagatttaatacccttttacagtttctttggcgagagtcttaaaacaccaatactttaaaaataatgaaaatgaacataataaaataaatgtgttgaccaatatccaaatagaagaaaatttttttaaaataatttcatatgtatctgaatgacaagtaggcttataaaacagctcctccccgtcgacttcatttgtgaaaacaactcgggtaaaaaaaaatgccagcaatataattggcttggaaacaatcttgtatagagtcatttttcctaatcatccgaaggcttcaacgaaaatgcaaagtctaccctccagaagatctgaaacaaacaagaaaataatttctgaaaaaatctctgaaacaattacacttaacaaattgcctatgtccagatacttgcactttttcctgtttactgtaacggatgtggatgatatctggaactttagcgaaacaaaagagagctctcttacatggcctaaaatcgatgcaaagcaattaaatgaatatgtgaacactgaattgacggtttatcaacgaccattttctttacttggaattcctcaaaacggtttattcaaatcctgtgaaaaaatttacgatgagttctttgcagaacatatggacaatgaaaagaaatatctcacctttccaagaaacagatctagcagatttggttttgaaaatgttcctcgagtaaacgaacttccaattttaataaatcattttgagaaaagtcggatggatgtaattctaaatacaaataaaattgtactcgtaaatagagaacttatatgggtgccttgtgaacaagtacgcatttttaatttaaatgtgtcactaaacattcccgacggactttttgggattttgactggaacagttaacgacactctctgcgaatgtgtaacagaactcatcacaacagaaaacgttatctccatttctttaataaacctgtcaagtgaatcagtaatgttgttacctggtgatatagaattagtgattaacatccttccatgctatataccggaaccctgggaaacttataattttccttctccaaattttatcaagttttcactaattaccaataaagatttctatgtagaatccaataattacacaatccaaaattttgattacatgtttgattgtcctgatgaattgaaagctttaataatagcaaacaaagaaattctctgtcatggattagtggttgaaactaatatctggttaaagaacacaactccaagtgtaaagatttttaatcccacttctcagaggatctttgtgcaagcaggaatttgtattgcaaccatcattttcacatgcggtcattttattttaaagctattacctaatcgagtgttgaatcagcttgcagtgttagataaaacatcgatgctttggtttcagtacagcacggaataaaattttatttggtaaatccttcgtaacattttttagttgcggctctctgttcgcttggtggatccgtaactgcattaggcagcgcttgatacaggcctgtttcttgatgtaacaaaggatcgatctctgtcaaaagacgcttgctattttcttcgtctaagtcaattaaagtatttattttttccatgtcacataatgttgtttggtctattgaaaatttattgagcaattgattcacattgtcactgcaaattgtaaattctccaatcataattttcatgaacacaacatccagagtctctaaaattttcttagctttcatgatttcaataatcaatgcatctttaacgtgagggggacaattatttaaacagcgttcaatcaaattatacctcagctttgtttttttatagataggtaacacttgcaacaaagttttgaatgtttcggagtctctttcatagttgagaatatcggtttttaaaattccaaaatctgtatattttgtctctaaaaaatccagtaaatcctcttgctctgagagctcagaatagagcatctggtagttagagttgaagatgtcagaagagattttttttacaaagcaatttcccatgattcctattgtcttatattaaaagctgttggaagataaactgaaagacattcacaatgactattactgtgtttgcaacggaatatgaccccgcgcacgtgatagtaaatatcttatgtaagaaccctagtgaacatttaatttttccaataatcgttaaatataaaccatcaaaaaatgtatatttttgtatgcagacacagaaatgcaagttttccaaaagaattgagacggtatttgtttgcgacgcagaatctttgaatttcagctattatgtaaaaaatgcattacccattaagtctgaggatattattcactgtttaaatacggaagaaacagaaaatctgtataaagattttttactttctcatgttccagaaggaagtgaaaatatagaatttaaaagcttagtctttttttgcaagactataatcattaaacatctaacaaataagtatctcttacccacgtcaccgttttggtttttatcaacatacggtcaaacagaaggaatgctactattaacgatgtattattatttatttgaagagcagaaaagcaccatagcaacaactaagaattatgttcagtgtttcactgataaattaggagatatggtatttacttattcctccatgtctgaattcattaatattactttgaaatctaactatcggaaaaaatttgttagtttttctgaatatgcaaaacaaaaaaacataagagatcgaaaagaatttctttatcttgataagcaaatagatatttttagaaacagcgtgcatctcacaaacagttttcgagtccactatatctacattgcttacagtacagcattagaaaaaaataaattcatcaagtatagtcaactgacatcttatgatcctaccagatctgatacttctcaatgtcaggaaaatatgtacatcctaggaaattctttacactcggatctcatttcaatcatgaaacagtactttaacgaagacagttattttcaaaattatgtagaaataaaaaggatgttaaacaacaaatttcaaatgcaacagtacgtttatgacataaacagtaatagaaatatcatgcttgtaataaattcagaccaaatttcaaagatggttaacaaatgcaataaacacggtgaagggtattttacaccaattaaattaggcttacaaggatttttaaaaattttggcatctaataaatctattttgatagatggtaaacctgttacaaggagacaatatctacatgaccaattcagcaaccccattcctatgtttagagttcaaatgtcttacaaaaatctttattgttttggaagtgcagaaagttggtacaaaaatatgggtttcgaccaggttatgcaatttttacccaatgagtacatttcggatgaatctttaacaagtacattttggttgcaggacacgacctttttaagcgacgaaatagaaaaacagttttacgtaaccaggcatgaaatctttaatgaataccttccggttacaaattatattggtgatttagatctgccattacaggattcagctataataacggaatcgttatttttctctatgtgtaaattgatgcggaatgtgctgatcaatgcatggcaaaaaatatttccgtttattgacaaagacgcctaccccatcttttttttcaaaactacctgtagtaatccggagaatcccctgaaccacaatgtatgttacaatgaagttgaaacagctttttgtgtttgcaaaaaaaaaattggtcttcgaattgctattccaatccctcaaggtactgcaataattggaagtgagccattaaaacaactttctaaaatattcaatcatttaatgtgtctaaaccacgatttaatgcagattcttaactcggttatttttcctggtgaatgttttgatacaggaatctataatacgggacgttgtttacggttaggtttcatgtataaagttgacgaagagaataacagatttttgtatggtcgtctgaagcctatttttattgtcccggaaaaaatgaaaaagaattttcaagatttcgttagcatgcaactagatctcaataatattttacatcatggaactaaagaccaaaccattacagagataatctacagcatttttgataaggcctgtccaacagagttttcttttatagattctaggactaagcaactgtatcacagaaaacaaagttcactggagactttatgtttgaaatatttacatgtcaatggtttttcggaaacaagttgtctttcccgtgatgatttgttaatgacttttactcgttcaattgcctggccacaaatgttaaaaaagaacatccaacactgtgaagcacgaacagctacacaatttcaacatgtaacttttctaaaaattgatcacaaaaatatacaactaaaaaaattgcaaaacggaaaactaagtgatttcagttgtttaacaaggaatcataagggaaaccgtgaaaatgtcttagtgtacttagaatttaaggtagataacaatcgcattttgataatattatggagcaaatgttttactacgaaatgtaaatctaatagtaagcaagtgcattcatctgtcgttttagattctttgaatatgtgacatttttatgttatttatttgtgttttgtaaataaaattttagacgcaccttaattcgtgtctagctttatatgtcaaatgttccttatattaaaaaccacagaggcgtcaccgctacacgagacaaaaataatataaaaggccgtttatgaacaaggttctcattttcgacagaaacatgtatccacgcggggttaaaaagaatgtattagggcggcaacgatatggtttgaaaaccattaaacgaactcttgttcataaacctgctaacaagtatgtcagccgctttacgaaacaatttcacagacgcatcattcctattaagcagcttgatgaatcaaaattagacgctttgagtctcagagaactagaacagctgaaactcatcattgaagaaaagcaggaagaaaagcgtgcacagacgcatgcattgacttttttcgccaatttaccaacagcaccttttggctctagctacaccgcggaagcccttggtttacgcaagtattccggtgaagcacgagatccagctcataggattcgagatcgatttccccggaatcatgaaaaaatctatttggaaaaagaagaactaatgacaacagacttgttactacgatataagaactgcttaaactccctcaatagagaacaacatcaacagatactcggagaccgagttttttcattgacgaattctccatcgttagcattttctcttgcgattattgaggaagcttgcatttactataaatatcattttgtgcacaacttacctattgaccctcaagatctgtttatgtatactattaccataatgaagtttgaatacttcaacaagttgaatatggcaaaactttgttgtgtttttaatgacaatggacatggtgacatagaataccgtattttcagacaactttgtggaaaaccggtatatgaccgtgatatgcctaacacggaatatgaagtacagcaacagactcctggatcttttcaatatccagcacagcaagctttatcatttatagtaacttttgcaaggattttacgtcaaataaaggaacgtattcttcaaactaaacaacctcagttcatacgcgattttgaccaagatcgtgtaagtgaacaatatcaatgtggcatgatttccagattagtcggagaccaatttaacaatcatcaatgtgatgacatcggttgccaaactagaatccaacgcatgatgtcaccttggaaaccaagcttatatttctgtacctatcttcccaaagaatttgtggagtttggtctgcatcctaacatgcctgaagagtacaacagctttaatgttgcatgttctacaactccgtcttgcagctttgcttcacagcaatctaagcaaaccgtccaattgaatttacaaaccaaaaagcaagccaaatgtaaaaagcttcttactgcggataaaacgaataaaggacagaaaacaaatgagctacgcgaaaacagactgaaaaaagactggagtaaagaagttgattctatagattttgaaacaaacacgactctacaggaagatgaaactcgctttgtatttattgaaaatgatacttctatgaaatcagcgaaaattaaagaaaacaatggagaggaaaactctgataatgaaatggaactggatttagattatgaagatgtagaaacttgtgagaccgacattaatgacactgattctgatgattcggattaatttcccaatatgtagcatctctgtggctgtcctctagctaatgctttgctgcaacaaattaaatacttgcaatgcaaacttctgattggtcgttgcttactttgcggaagtgggagggttcattgatcctccttgcctgcaattctattttaaaaaccatgaaaaataaatactattacgagtgaggtggacgctaatttgcataaactatcaaatccgagtcagtatatcgtttttagttctccgcactaaaacagtagaacgagaaaacttaatttccgttgtatgatgacgctaagttttgttacgtcaactaaaatatataaggtttagcagaaacaccccttgcagaaactggggtcttcatgtttcaagaatggctgatgataatgaaactgttgtttcggccccaatatgtaccgcagcatggctgtacattctgccgaaagaacaaaaattaatagaaattctgactacattatcgttaatggaaaaaagaaaatcagtagtgatctcacccttgttacttaatctaacggttgaaaatgacttcttcccaaccgttaaaacacccattattaattacggcggaacagtcattaccaaaatcacatcgtttatgcctgtatgcttctttttccacggtacagatgtttttttaaaagaagcagaagaccatggaaatcttgataaattgtgcaaacaaacaagagaaaaattcaatctacaagaatttgtcgttaacggaaatcgaaagtctgtggatataggaaagatctgtgaaagtgttggaagaaatgcagatgacgttctatgtcatatagttgttgggaatggtttcaaagaacttttatttgctggattattaatcccatgtgtagaagagcagattcaagtccaggttggtgaatgcttggcaataaaaattccgttatattcggctaccttgtttgaatcggaagaaactttgtgcatcgatacttgcactgaattcattcaagaaaacggcttttatgcgcctcagatcagcgaagtattgttctacttaatctttacatcatggggaatgactttgcgatttaataataccctggaattgattaaagccggtctgaaacaatttatccaagatactgaacaaactgtcaagcttgcaccgaataaaacatatcacggtattcctggtcaaaaactatcaccgattgaaaaagatcatttaatgttagtggacgctgtaatcacggaactaaccttcagttacacagcagagtatcttgattctatttatgaaaataatcaaatcatgaatttttcagagtggcccatcatcaaatcggctgaaacccacgaagagaaaatcgtggaactgaaaaaattgaggctccatctatctagccatgtagctgctttagtctttgctgcgaattcgatactttacagtaacaaattggcctatatatctaacacaaaacaagcttttaactctgcgatcactcaagaaacattactgcgttcaatccagttttgtaattccttgtcatctcttaacgaagatttttataacgatgccagaaaattgataaagtgtaattcttcaccttgtaaagaagataaattttccgcttttcatctagcttacgcatgtgcgacatgtccacaaatcttatcgcatataatatggaatttgaacagaatgtctatttataacacgaactgtggaaattctgaaatatataaccacatcgtaaattgttcctctaatctctgtgagttttgtgaaggtaagtgttgccattcgtgtatcggaacagcattgatcagaatcaacagcagattacctcagatttctaaaacgactaaaaaagaacctattgttatgacaatgttttctcgtttttatgcagatgtagatgttctaggttcttttgggaaaaagggagttaatgaaagcaaagatccaatgaaagaagctcaaaccacaccttccttagatagattcaaattcttaggaatgattcacgattattgtaagaaaaataatttgattgatgcaataactggggaagacaatttaaattttaaaagtcaaaatgattttgtgaatatgattaatgatttaattcaatgcattgaggaagcagtttcaaaatgtatttcagaaatgagaaaaacgcagacatccagagaacaaatcgaaaactgtctacaatctttcaacattgatacgacacctctgtctttggctttttctccattctttgttttcacgtattacaaagttatactaattgttttacagaacttggctttaataatcggtacgggctatgttgtagataggccttgtactggaaacttaatttctaaatggttaatgcaacaataccaatctctctacggagcattttacaacagtcattttaaaaaaggttttttgaatatgaaaactgtaaaaatagcctcaaatgtagacatggaacaatacattgatttcaatttgtttaaatcgggtaaatatgctaaaacctctatccaagctaaactctgtcgcctttccatgcaatgtttgaaagattttcgagtaaaaaatagaccattcaataagccaaacaaaaacacacaaaataatccttttttcaaaaaggtcaaacagaaaaagaacccactttctggttgcttatcatttttgctgtttaaatatcatgaacggctctttccaaatttaaaaatatcctgcctagaattttggcagcgtattttgcttaataacatgccaaaaaccatagatataggtaatgttgaagacatgcgttctttcatcaagtttactttccgtgtcaccaattcatatgatgaaatagatttgttagatattcaaccagaatgcttactatcctttatcgagtattactttcataataaattattatcagttcttggttatagagattatctaacaagtttgcatgcattaacttctaaactagttcctcaaaaccctatgttattcccagtttttcttaaagaacatccaacattttcttctgtgcaggaatacgtcatgcacgtaaaaaagttggtagggaatggacttaaagaacctatgactgcatcattaacaaaagaaccaaattttgggagcattttcacaggaagatctattattacctttggtttaatgatcgaaaaatttgtgagtgttgctagtagagattatttccactttggtcagttaggttggatagctggaagtggtgtagatcgcaatttaaaccctccttcctccggcttgcaagatttccgttttatgcgtcagaaatttgtgattgctacaaaactgtgtgacattattgtgaagaaagttaagagagaagccattgtttatgatgtggaagtaattcgaggaaaggtgctcaacattattgaaagtttatccaattctgtaaatccagaactactcatattagctgaagtgatgaaagatagagatagtaagcctactatggatgatatgttattctacgtggatggtagagagcctctagcaaaatccgtaatgaacaagattcagcatttaacggatttaaatgtacatgatttttctctttcaactttattgtcagtttttgaagaacaagtagaagatagtgctgccatctatgatttttcagaacttttggtagaaggtaatgagcaaggttttggtatattaaaatgtgaagagactgagcatgaaaatgaggaaccctccttaaaaaaagctagattgtaaaaatgaattctttgcaatcattgtgtgtcttgtgttcaaggttaagtgaatgtgctttagaattagagtgcttacgattttgtgaccctgtcacacttattccagatatgacaaatttcaggaaaaacggtgttgtaataattcatttgtttaagacattatttgctgaactctgtcatcaaaattttaattgtgcatctcctgtaaccatttatttacagattttattaaaagctatgtataatcaagtcttattactcgatgcttcaattcaccaatttctattagataatgacaaacaaaaatattttgaaaatatattccaactcaatgaatgcaagcaacacttaaaattggacttggctcttaataattatttgactttttctgtagacatttctacgatcaatgatattgaaaaacttttatgtaagatgaattgtatttttggcttaatttcaccactggatggcattaatgcttgcagtcaaattattgaatttctaacaattttgtgtggcgtttgcgtagtgatgaagccagaagttttttctgaaactactacatgtttaaaatgttatgaagaattatctttagtgcccaatcaaggaaagtctattcgtaaaagactagctggcaaattttgtaatcatctaactgaaacacatatggtatccaatttagaaaaaaacgttgacatcattgagaaagatttggatttttccacaaaacaatatggtcttgtaaaagagtatatggcgaaaatcacaaatatttttcaacagcaactatattcaaaacctccacatttacaagaagctgaaaacactttaatcaactttgacctttttagcaaaattccagatacaatttattcgttgagtgaattcacctattggtctaaaatttcagaatctgttattcaaaaagcttcaataactctaaatcaactaaatctttgtcattcactttatgctgatctccaaaatgaaattagtaagtttttatatggtgaaactattcaagatgttttcaattttaacgaagaaaatgttacaaatgatgacaaattatacatcggatcgagatttatttccccttgcagactcgttgatattattaccaatgttagtataaaaaacttagaagaagatccggtttttacaaagctggcagaggaagatgaaatacaaactaaaataaaaactttattaaatgaacttgaaaattcagctcatgaaactgtcccaaaaaaatacgtaacgcattcaatgacacaagatcacaatttacaacaagagattcacattagaaaaaaagcttattaccaaaaaatttccgaatcgggttatagtaaagtaatgctgtgtatcaaagagcaagaagcattaataaataagttaatgaatattaatatcctaggaaatcacattttcgaaagtctttcgaaaatgatgaacgcatttgcaaatagacaactgcagtcactagaaaatttctctgctgatccatttacttatgatgatcacttatacattaaaaacaatctactttcaaaaaaattgcctcaggaacttttacctaatttaagtcaagaaatgtatcgattgttgactggtccattgtcgaattatcacaccgcttcttttccattgtccagcaacatatccatggcgtatgcttgcgatgttgcagattttttaccacatatgaaagaagatctggctaaatgtgttgaaggcacgatctacccggaaaattggatgctgtgtacatataataaatttttcaattttgatggtttgcataatatcaacgatatgcaaagacaaatgtggaattttatcagggaattagttttgtctgttgcactatataatgatgtatttggaaaacaattatcaatcgtcaagtttggcgaagagacagaaactgtcgaaaaaatacttttaacttttgatagtggttctcctttactattcaagcgtggaacgaccacgacaaaatttaatgatttgtactctttattgtatttcgatttaaagactcaatgcgatcctgttcaaatttcacaaactaagcaagtttcccatataccggctccaaatctgttagatctatgtagacaaaatgaaaattctattcctgagtgtttttataacttttagcttacagctatctctacaaacagaagctgactttgtcatgactggacacaatcagcatttaccatttcgaatttgttcaattgccaccgggacagatttagtgcgttttgacagggaggtttcttgcgcgtcttacggctctaacattaaaactaccgaaggtattttgataatttacaaaacaaagattgaagcacacacgttttctgtcagaacttttaaaaaagaacttacatttcaaacaacatatcgcgatgttggcactgtgtatttcttagatcgaactgttacaactttgccaatgccaattgaagaagtgcacatggtaaacaccgaggcgcgttgtttgtcctctatctctgtaaaacgttcagaggaagaggagtatgttgcatatcataaagatgaatatgtgaataaaacgttggatttgattccgttaaattttaaatctgatactgtcagaagatatataactactaaagaaccatttttaagaaatggtcccctctggttttattcaacatctacatcgataaattgcatagttacagactgcattgcaaagactaaatatccttttgatttttttgctttatcaacaggggaaaccgtggaagggtcaccgttttataatggtattaattctaaaacatttaatgaaccaacggaaaaaattttgtttagaaataattatactatgctgaaaacgtttgatgatggatcaaaaggaaattttgtgacgttaactaaaatggcttttctggaaaagggaaatactattttttcatgggaagtgcagaatgaagagtcttccatttgtttgttaaagcattggatgacaatcccacacgctttacgggcagaaaatgctaacagttttcactttattgcgcaggaactaactgcttcttttgtcacaggaaaaagtaattatacgctttctgattcaaaatataattgtattaacagcaattatacttcaattttggatgagatttaccaaacgcaatacaacaattcgcatgacaaaaatggtagttatgaaatttttaaaactgagggagatttaattctgatttggcaaccgttaatacaacggaaattaacggttttggaaaatttttctaatgcttctagaaaaaggaggaagagggaattagagactaacaaagacattgtatatgttcaactacaatacctatacgacactctgaaagattacattaacacagcactaggtaagcttgctgaagcctggtgtttaaatcaaaaacgcactatcacagtgttgcacgagcttagtaaaataagtccttctggaatcatttcagcagtgtacggtaaacccatgtccgctaaattaattggtgatgtattagcagtctcaaagtgcattgaagtcaaccagacttctgttcagctacataaaagtatgagattgacaaaagattcaagttacgatgctctaagatgttattctcggccattgttaacatattcatttgcaaattcttcgaaggaaacttatttaggacaacttggtttagacaatgagatattactgggaaatcacagaacagaagaatgtgaacaatctaacacgaaaatttttttgtctggtaaattcgctcatatttttaaagactatacgtacgttaattctagtttgataacagaaatagaagctttagatgcgtttgttgacttaaacatagatcctttagaaaatgcagattttacattattggaattgtatacaaaagatgaactgagcaaagcgaacgtttttgatttggaaaccattcttagagaatacaattcttacaaaagtgcgctacaccatatagaaacaaaaattgcaactgttactccaacatatataggagggattgacacatttttcaaaggtcttggcgctcttggtcttggtttgggggctgtgctgggtgtaacggctggtgctttgggagatgtggtgaatggagttttctcttttcttaaaaatccatttggtggagcactaactatcttactaactttgggagtgattggcttagttattttcttatttttaagacataaacgattagcacaaacaccgattgatattttatttccttatacatcaaaatcaacaaattcggtacttcaagcaacgcaatcggttcaagcgcaagtgaaagaacctttagattcatctccgccttatttaaaaactaacaaagacacagaaccgcaaggtgatgacataacacacactaatgaatattcacaagtggaagctttaaaaatgttgaaagctattaaattattagatgagtcatataaaaaagcggaaatcgctgaggcaaaaaaatcacagagaccaagcctacttgaaaggattcaatacaggggctatcagaaactttcaacagaagaactgtgatggatctggtgtccttctttaatccgtatctagagaatgtacgaactaagaaaaaaacaaaatctacttttctccggatttttccgcgcggtataatgcacgatggagcacccggcttaatgaagactctttgtgactcggaaccgagaatgttctatcaagataagcaatacattctcaaaaatgatatgacatggccatcgctttctcaagtagccgaaaaagaattgcgtgcgcctttaaaatttcatatctatgatgcatccgaatctttattatttactgattctatagaaaacatccctttccaatatagacatttcgttattccatctggtaatgtcataaaactttttggaaaaacagaatgtggtaaaaaagtttgtatcaatgtatttggacaaaatagttatttctactgtgaatatcaatgtaaaaaagagctgaattctagaatctgttcacttctgaatagttctgaaataaaaatgtcatgctcattttctattgaatctgtaactaaatacaatttttacggttataacacggaacctatcaaaaatttatttaaattatcattttcaaacttttatatcagtaatcgaattggaaaaattttactaaatgagggcgtttctgtttatgaagcagaagttgagattctcaatcgtttcttcattgataacaacttaaaaagctttggttggtaccaaattaattatctatctattcaagaatttgcaaaaagcagtaatgttgaaattgaactaaattgtcatgtgtcagatttatttttgttaaaggaagattcttggccattatatgattgttgttcttttgatattgaatgtctaagccaaaatggaaactttccagatgctgagcaaatggtgacatcatcattaatttcggtcatcgattttgattctgaaggaaattaccaaagtaaacatttgtttactttgggcacttgcgagcaaatcgaaggggtattcatctatgagtttgcatcagaatttgaacttctatatgcttttttcctttttttaaaatgtaaatcaccagaaatccttactggatacaacatcatcaatttcgatttaaagtatttatgtacgagaatggaaaaaatatataatttcgagatagggggtttttcgaaactaaaacgtggaaagttttctgtcatcgttccctacgaacagcataagaagtttttgaattctttaactaaagttaacatgtctgggattttatgcttcgacatgtataatgtgtattcatctaaaatctcagctcagaattataaattagacactatagccaaactttgtttaaatcaggaaaaagaaaatctctcttacaaggaaattcctaaaaaatttattgatggttccaaaggtagagctgtggttggcagatattgtatacaagattctctattggttgttcagctttttacaaagattaattatcactatgaaatggctgaggttgcaagtctcgcttatattactattcgttgcgccgtatttgagggacaacaaaaaaaaattttcccatgcattttacacgaagctaaaaatttaaatatgattttaccaagtatgaacactaactttaataaaggcaaagaaaatgtgggctataaaggtgctacagttttagaaccgaaaataggttattatgctactccaacagtagtttttgatttccaaagtttgtatccaagtattatgatggctcataatctgtgttatagtaccctggttgttgatgaaaatgcagtaattggtttacatgcagatgacattctcactgtgcatgttggacctgtaacgcacaggtttgttaaaaagacagtcagggaatcaattttagcgagtttattgaaaaaatggctggataaaagaaaagaagtaaaaatgcagatgaaaatgtgtaacaaccccgtgatggaaatgcttttagataagaagcagcttgcattaaaaactacttgtaattcagtctacggagtcaccggggcaacacatagcttacttccatgtgtggcaatagcagcttctgtcacatgtcttgggcgtgaaatgctttgtaaaactgttgattacgttgacagcgccatgtattcggacacttttttcattgagaaatttggattgacacgcggtgatttttcagggacatttggaatagaggtgatttatggtgatactgacagtctttttgttactttcaaaaatgtttgtcccaaagctttgaaaagaatagctccttctattgcaagccacataacaaacacgttatttaaacatcctatcaaattagaatttgaaaagatcctatttccattaattttaatatgcaagaaacgttacattggaaagttagatgatgcaacgcttgtttttaaaggtgtggagttagttcgcaagacttcttgcgattttgttaaagtggtagttaaagacatcatcgatcttctcttttgggatgtcgatgtacaaaagtctgctgaaaagctctctaatatgacaatacaagaaatctatgaaaatggagttcccgatggtatccaaaaaataattaaaaagttgtgtgacgcacgagacgcacttttcttaaacagggttaacattaaaagtttggttttgtcttcagtcttatcaaaagacatttctgcctacaagcaagcaaatttaccacatttggctgttgttaaaaggttagctcaaagaaaggaagagttgccaaacataggagatagagttatgtacattttaattgcacccacagaaaccgtaaaaaaaacatttcataattatgagttagcagaagatccagcatatgctattgagaacaacttaaaaatcaatgcagataaatattttgaacaaataatgaaagctgtaacaaatgctatctctccaatatttccgaaaacgggcattaagaaagaaaagtttttactttcaatcctacctttaaaagtatatgtagatcaaagcttttgtgacctgacagatgttctgtgatctgttttaaataaacggtagaatgtgtttcagcttttcgaacttgtcacctatttcatcgggtacgtccatttcctcaatttttcgctgaagaacattaatatcaatttgaatattgctagtctcaatagttttacaaagaacatgtagtacaatgctgtcgtgtaagatgtctaaaagtacagtgtatccggaagagactgtcataatctgattgatacattcgcaaggaatatgaagagttcttgtttggaaaacaacatacatatttaatttctcgttattttcaaacatgattggtaaaaaattacttgctatgcttgaaagaatataaaaaatttgaaaaagcgttggttgcttggctgacatacgaatcagttcaacctttttctgaaaaccgtagtaatataatctattttgcattacgtttgaaatttgattcatatatgccaccatagcatctgaagctgttggaatgtttgttgtaccacaattaacacatgcactttttgaaacttgttcattggcatatggtgataagtctaagcacgtatgttgatgatgtagacttagatcgaatggaattttgataggttctttaccggttattggaagtttcatcatatttagaaatttcaattcatactctggaaataatttgaaaaccgaatggagttctttaagtgacaaagataaagataagttagttttttctttgttgtaaggtttgcttttctttaacaagctagatgctcgtctcagtctacgtgtactttgaatagccatgctaaacgtaataatgaatggtaaatgtaggatcgacaatttcaaagttttgatctgctaagagctgtgtgaaatcctttaagaaatcagatataagcgttttatttttgtggtttaattttgaaacctgaaatgctttaaaaaaatgaatggctaaccaaacatgtttttcaacactgtttaaatactcattctgataacaaattgcaactttgaagtcttgtagtatacagctttctgttgtatagaataaaatatggggttttattgtcttaatgtttgctatgcacagtggatcacaaaagaaatgtttgtataatcccacaggtccaacctgctttagaattaaaaaactatgacaatcaattacaaaatcagagtttgaaaattcttgttcattggctaatacaatttttgagcaatctgatgtggttttaacgttagtatatattctagctaaatctaaaagatttgcgagtacgaattgaattctgtcaatcatcttcaaattattttgacagtaattaatgacactggtgtagatgaactgtagcaagtcgaaatttttctgagaagatgtcattagttcacataataagcatacgctactggtggcgttcttagtgatggagatcggtatttgagatagtaggattggtcccgcagaacaattgagctcatttttagtagagtaaatggcttttaaaatttggcgtttcttgatggctagatcagttagtgaaatgcgatcgaatatgtttgtcccagcccacatataaaaaattaaatgtgtaaaatgcgtgttaagtggaagagtttgtttttcaaggatagcatttccatgctgttttttcgttggttttccttttaatttaaatttctttattcttatatttggtatagattcgtcttccaatagaagtgattttaatatggccatgtgatataaggttatgttttcattatgtaatagatcatcgttggtgtttgagaaacacctgtttatgaaaaagtgtacatgaaaatcgagtattgacaaaatgttgtttaaaaataacccatcgaaatttatgtttaagaaatgcttttgaatcaactgcataaattcggtggcgattattacgacagccaagggagttctaggtgcagcattacatttgtaacacaaaagagcatagtcatagatccacattttatcggtttcatgtcgtaaacagatgtttataattgaacatatattgcatcggttgtcaatatttaaagcagttgtaatttttttcagttcttcaatatttaaagttttttcaacggagttaatttcattttcaagtgtattgggatttgtgttaagatcatcagaatctattccacttgaatctaagtgtgcatataaaagaatttcattaaaaagttctgagttcatagaaaaggaatcggagttccatcccttataagccatgtctaacgacaatgccaaaacagatatagaaattctttatgaacaattatcttcccgagttgaaattgaaatagcttttctccctatgttaccaaaactgtacgatataatgctgccttcattagatgcccgactacattttattaatgttggatacagacacttaacctatttaaaatatttacatcacagagcaaatcaatgcagtcactcggagattatcaaaaaaaaaatcaaactactcacttcaattttatcgaaactgttaaatgtgaatggaattttagaacatcaggaatatttaaatacataatatacaactgcagaaatttttaaagagaaaataaacatgttgaaagaaaagatgtacgatgaattaattctttccacgtgccgcgttttaaaattgggtcccgcagactttcgtgtcacagataaaaatttattttctaaaaatcctaaatttcctttatgtgatatacttttaaaattggattttgcatatagcctggaatatttgctgagtctctgggaagatttgacaaaacaagaagcgagatttatttttaaaaatacgggaggtgctgtttccatgtcttgttatctccacgctcccataaaacaagaaagtcagaacattgtcaaagaatgcaacatcttaaatgtcaatgagtgtttatctgtgtgtttgaatgacattgaagctattaaaccttcttcaagtggtgtactgacaaagtgcattattagacgaaaccgagatgcggcttttatagttgaatttgtggcttttggtcccgagagtgaatctgagtatatcgctcttcttaaagcgataatcttaaagaaaaaatttttagagcgccaagatttagagaaacatagagctgcaaggcacataaaaaaaccattgaggttacagttgaagtcagtaggagagatgacatcattcaggagtataaattacatgggaaacacaaaagacgcagcagtattcccagttactgttcctatttttgcacggagaaataatattctttgtggttttttggttgccgccttactaattgtatgctatgtcatctttaaggaatttgctttgtcggctgatttctccgctgtgtaaacatggttcgtacagtcatttgcagttatttcttattggagatgtcagcaaatctgaaaattgcgtattatcgatgttcgtaacgaataaaaagtttttgagtaaagatttaactgataatttctaccggaagtttttaaaagtttggttaaagtgtgatctggattcaagaaatcagattaaagctatttttaataaaatgatgatgacaaaaaatttctttttgcttttggcatatttgtattttttgtacaggcaatgcaaggttctaaaaattctggctctttacaaaattcaacgtcttacttggaaacaaattgtggagagattcaaacaatacccaatacataagttaaatcagttgttggaaataccgtcgtttgtgtcttttaatgatctctattattatttatttcagcaacagttaatgttgccaatttcaactcattgtaatattccttgtatgaaactcttttgtttacgtaactttgaacaatgtaatgacatcacactgcgatacgctcatagagcaagcaacctgacatatcaagatatatttcatggttgttctttaacagttccatgtggaaattttatctttgctatggccatggccatgatagaaaattattgttacagtttcgatcgttttttaatcccgctagaaaataataacttggtgccgattgttttgaacaaacaagaaaaacatcaacttccaaaaattctaacttttgctttgacgacagtcttgaaaagaagcttaacttcaagtatcatctctttaccggtattatgtttttgcaaaacaaagtgtctcagatatgctaaaattgatagttatctcactgtgatatgttctaaatgtggacattgtttaaattccggcaaagagaggcttaaagggaaacaaactttttctttaagctcgatgttttattatcgagatagacaggaaaaaaatattatttacagtatgcacacagatttgctttattgttcattatgtggcgggcaacgtttgacacttgaaaaagtatatgaattgtatgaatatagtgtttcaggcattcaagtaaaaagtgtatcatggaaagctataattggaactaattccgcttgcactattttaaacgatagtgttaaatttgatgccattgttgcatgttcttgcagaacttgttactctatgatccatctgcagaatctaacgataaataaactgttgaaactaatttctcactccacagaatttcaatgccaagattgtcaaaatatctacagagaaacgtgtcttgatctagaggactgtggagaaatttgtacaggctgtaaaatttctcaattagctaagtgcacgcaacatggctgcgacacgtggtgatgaaatcactgctcaaatcaaccagatttctggcaacagttcaaaaaaagaagaagaaaagaaaaagcaacaaatgtttacgaatattctaggcttgcattcttctatgggttcacaccctgtcacagggacgtttctagcaaaatatgcaaaacaaaataccggaaacattgaaaaagcagccttcagacttgattttttacgcatgcttgctttgcatagattaaatagcaaagttagcgaatcatcttaaaagtacaaatgttttaatttggaaattgtttgatcaaaatctgtagaaaatgttttgatttcaccctttgtttgagacaatatattgaaggtgtctattaaatgcgtttttgtctctttagagtctgtgtgtgcagtgtttttttctggtaaaaagacaatttcgttttctttgggtacaagtcctttgatagggattctttgaatcgtgggacttgataatgtttccgtgtttatgtcatcggtagtgtctggtagtttgtaactttttgccgctgttttaggtggaggagagttaaataaaaatttggtgttttttggatagttcgtaaaaagaatcacatttttgctactatactcttgcacaggatttgggaaaatattcttaatgcgaaagctctgctctgtctggcttgcttgttcagggggcacataagttgacacgacttcgttgtcaccgttaaacaaaaccagtggaattttcttcagacttagttgtggttgtttgatgtcagcaatgattttatcaagttgcacgtgaaagatggactgttctaaaacattttgtgtccatgattgtgttaaaagatattttagatcgaaatttcgagattgcaatatcgttctaaagtctacgttttgctggacattttccaaatgtcggatcgtaagaagaaaatttttgatggaatccacataatatgaaaaagtcatttcagttgcggttaagtatgaaaataatagataatctaataaaaactgcttgcctaaaaagatactaaaaagagaagtgtttgcatttttttccagcacgaatttcgaaaggattctttcaccatgttttaatgcatttggttcttggagatttaatgaaatgggctttatgtgattctggtgtgtatactcgaaacataaatcttgaatgagttgttggaatgaatcctgagcacagcacgaaggtttgtattgaatccaaatgtaattcaaaaaattttgaggaagaaccaacgctgataaaaggtaaataaaaaatttctctttgcccatacataactgcatcaaactgttctttttaaaagtgtatttttctaatgttatttcactccaggtgttcaaatccaaacacacaatttttaattcatccatagatagcttgggtggattgtcagagatggtaaatgcagtgaaatattttttcttttccaataagggtattagagaattaatagctaggtccactggacactgcagagaaccaaaaagaaactctggattatttgctataattaaaagagaaaatttttctagtggcagttcaaacgaatgctgtgtttcatcagatgtgactgaccaggcctgagtaataatgtaaataaatattttaagattaattattgggaaaacattttgaaaagtaaattctgctttcccttggaaataagaagttaaatcgaaatttataatctctttccaaaagctttttacaacactcagaatgctttttaatgtggttaagatcttatacttggttgatactaagttcagcactttatcaggtacgataattttcttataatttagagcaaaaaacttgaaaacaatattgtggaaaacattgtaaaattggactggaattcctttctcatcaactatcaactgtgtattaaaaactgaatcaacctgaaaaaaagtttggggtgtgtgtattttcatacgtaaatttatatctgattttggaattgttttgacggtggaaagttcgacaggaatgaaattcgtctgtggaaataaatccgcttgctctgttaaaacgttttgtagaaaattttgtgctgcctgcacgaaatggcttaaagcctcaagtgcctgcaaaaagttctcgacattcattgaactgacaaaagtatcatctaaatttggaaatctttcaaatacagtgtctgttctaagagttttgaatttgtctttcagttttaaaattaaattttgttgatggttaaaatcgaatgcgaaccggaaatgggcgatgttatctaaaaggtcaaagtactgtttttttaactgttctttatagcgtgtttgttgctggttcgtttcagctgttagaattttgctcagataatcctgaaatttctgtttaccaccagcaatacgatttggatctatttgttttatcaaggttgagagtttttctatattgtcagtattttcgataatttcgttgcagattattttattttcaatctctatgtacttagaattaatttcgtattccaaagctctgaaatgtttatagtcaaaggggataacttctccaaattctgacattgtagctacaaaaaaggtattcagttctttgacaaaaactattaaccacttcaatattttctcactaatcacatacgctaaatcgtttgaggctttgtttagagtttcagttataactttaatgggatccttgatcaactcttgtgaacttattgtcagttctggtgggaaagatatttttgacttggagacaaaatctttccatttgttatcaaaagatagattaagaatctgtatgtggtcaatttttgtttttaagtgtgaattaaagtgttttattagatcgtttaatttcatttcgtaattttttatttctacctctattgcgcgtttaaaagcactttctcgaaaaactacgttgccataaccttggaaattaacagtttctatgttcaggtagatttcctttaacggaatcgtacgcgacagctcgatcttttgttcggatgctttaaaaagtttagttaacgactcttttgcatctgttgctttttttcttaactctgttaatgtttcttcgtatagtttgaaatcctcattataaatggaatgtagaagtttacctttatttgtcttatgtctaaatttataggtaaaatctaaaatttggataagaaaatcagccttgttttgaacatccgctgtggcaaaaagtgattgttttaaggcgtttaaaaactctttcagattaccataagcgtctttaaacactaataatctactggtttcgaggggcctatttattagtattttctctaatatttctgatgaatagctttttaaatccttttcaatgtcaagtaaaactgaaagcagagcatgtgaaaattgaataattaggttatcatctggtatcgttttaaatatattttcgcacacaatcaaaacagaagcctgtatggaagcaaattgtctgtctttcaataagagcagtaaatcattcaggtgtcgttccagattaattttagaacaggcaactctttttttgtcatcttccattgcttgcttggcttggttttccatatgtattaaaagtttctgatctaaattatttttgtgtttttgtatgatacgttgagtgggagctgaagctaaaaattgagataattcagagggtgaagttaaaattatatttttagccatttcactccagacatcttcctgatactcgattactttttgcttatagaacaagtgtattttttcaattagtttttgaatttcttttccaaatggctgatgttcaaattttcctagttgttctttattaatatttataaatcgaattaaatcctcagcatcttgcaatgatttcatgtttagccatttttttacaatatgtctggaaatatatccggtttctagtagatgtattctactgtcggctggaaaaagctctattataaataacattgttgacaaaacattttcttgagcaggtatctcgttaactagatcttgaaaataaaaatatagaatattctggactttttcttgtagagctaatagtatatcaggtcttttttctaaaataatatgtaatttcaaagatttcacaaagttaatgcttggaatattgtgaatggagagttgtaaaatgaagtcttgtatcatgcgtaattcttggtctgaaaataatacttgatgtgttaatgtgtctgttttcagatttattgtatcatccacatccatagcattcaactgttctaattgttctctgagcatattctttgtggcaagtttttgttttccttctggtgtaactgatttaaactcaaggttctctataatttcttcagctctatctatcagagttttttgtgatagaaaaaaatccaggaacattttgcggacagatatagtaaacggtgtcaaattttgcatattgaagcgtgtcaatccaaatctcagatattgcgtattgtcgtaaatttgttcaatattttttatcaattcgttttccaccacaaatccgttaatggtgatgctatagacatcaaaatagagtttgaccaaataggcaaacagattattaagatcgttcaccggcagaaaacctgcagcgatgttattataattttcttgaataattctagttaatctttgccccattgtactcaaaatggctttcagcttagcatgtattaatttttctatgctgtgttttttatttgatgtgaacatactttcattgggtatggaaactttatctgtggataatgttgggatgtctttttctgagacttcttcaacattcactttgcgtgcattttccggatctaaataatttgctggagcttctcctatgttctcgatgaatgcttggagttgaacaaaaccattcttttcgatttccacatcttttagcatactcattctttttttattcagtagtagagcgatgctctgcttttccttcttattcaaacaaatgaaatgatttaaggggttttttaacacgtagtcattgatgaaagcattggtatcctcgggatgtttgactagtttttgtattaagttagttagccatgtgtttacaagcgtgtagtgtttttcatgcaccggactgacaatggcgctaaacttcgttaataaaattctttcaaggtttttgaatgcagtagttttcgaaagatagtttttataaagcaatattagatcaagattattttctcggcaagcctctatagcgttttcaaattcctcagaaaattctttgaacggcaagaaatgtgtgaagaattgtttttgctgttgtgtctcatcccaatgatcgtttttaatcataattaaggcgtcaaccacttgagaaaatagatggaataccctattccatataaaaggttttgtaaatggctgtgtagactttgttgcaaatttctgtatgtaaagggtccaatttacattttcctttacaattgggaaattagaaagctcaaataaaatattgttaaattgaggtctaagctcataaaaacttggtactaaatctacttcattgttatagtatttgagtgatgagccctgcttcctttttttttctagagaatttgaatttagactggttttttcttgtttgcgtttgcttggtgattgttttgaaattaaagtgtttgtttccgctgtctttgttgaggatgtagatgaatacattgttaaaaaatcattcaaactaagagctatatctggatctttgtaagtctttaaaattaaaattgttgcatctccgtcttcaagagataaatcagtcgtttcaatgaaatatgaaaaaactgcatcatagtaaaattccgcaacattctctatggccaatagagcatataattcgtcaatatcctcacagatatagatggctgcagagttttctgtgtctgatgcatgtgaatcaaaaaggtaaaacaattcatcaactataaatatagctcgtgccattacccctatagtgatgacaataaaagctggtttcttatttttcccatacaatagaaagtctaacagtccaagataaacttcattatctatatgttgtgattctaaggtaccattaaagggtctagataattcatgtattgtttcgccaaaattagaactaattttttttgggatttctgtgaaaaatcgatattctgggatattgccagtttcgagtttcaatgtcgttgtactgatattatccaataatgctccattttccatgattatgtcaatagactctttatttaacacattgtttattccgttcaaataaactgtatgcaagaaagaaaaacaatttgacatacattgctttccggctcttggtccgtatttaggatcgttttgatttgtgcttcctgctatgattctcatctaaccaagttttaagagtaaaggctcgaccaaatcagcctgcgcagcttcactatatgcaatgtaccaatgcagatacttttcaatttgtggtattagtctatatctttcatcaaaaacatccaagaatggaatctgttttatgtcgggtattccttctaacataaatcttctttcaatattaattgtaggcttctgcttttcaaacagattatttagatgtgactttaatacagtgacaaaatcatcttgcacatttaattgattataggtgtcctgtttttttacaagttttttcgcttcaattaattgtgatgcgagagaaaagttaaagatgtttttagtattcagaacatcaatgacatacacgatgtttttaaaagattggataagttgcatgtttgaaaaatggcattcatctatgctattgagaacatcttgatatgttgtatttgcatgagaggagattctttcaacaataattataaaattttgcaaagtttgatttgagactaaatccttaaattttgtgatgtttttcacaacattttgtagcatctctataaacaatgtttttgaaactttgatttcttgaagcctatctttaaacagtttagattcctcaattagcttagagcaagttctataaaaagctgatagtgaagtacttccaaccttgtttttcccaaaatacatatttactgcaaaattttctaagttcaaatagcacgtagttgccaaagtacttgaacatttctttgtgaaatcgatgtattctttaagaagggctatattttcactgattgttttttgtatccaaggattcacataagtttgcatatgcacagtgtatgctgttaataaaaggctgactaaaaaatttgtttttggaataaaaatagtttgggtcagagaattaatattgtcaaaaattttttgagtaattgcatgtataattgaaaaatggccaagatctactttgaaaatttgtagtgtgaaagcgtgtaacaataataagtaatgtgataaaagataatttgatggcattagcagtttacacgcgaatattagtattagtaatcttcgattatcttttatttcttcaaaggttaagtttgtgattaatgacaaagaaggtctgacgtaatgtgtaataaaaatgaatttgaactctgggtgagtaatatatggtaatagactttcatacgctgtttccatcttactttgatatgctgtatcacataaatttttcaaaactgtacttgatacatgcttgtcggtatatttctgtggcgttgtcattgaataagttaatgggaaaaacaattctccccatttttccattaagtctttataaagaaaatctttttcgtagtcatcggcacctttagaataaaatttgaaataggtttctgtaactgtgctactaaataacaaatctacaatttcatttacctctttccaaatgaaagagaactgttcaccgagaattagtatgatggatttttgtttctcgaggataagtttttttttattatggaaaataaaagttgggctgaataactcaatacatagaaaaaaaatatatgccgaaaaaattattattgaaaaattcgtgaaaaatgtctgcaacttattatttgtcgtcgctggtttgtatgttgttaacatttgtaaaaaaatttgtgccgtttcgatattcaagcctattctatgcaaatgatagattttatcaagcaactccgggaaagtgatttgtaagttattctttttaattaggacttgctgaataaccgtgtttaagaatccatttatttttcctaattttttttcttcagttggtgtgatatttgttctatgcaagatgtggtatataaatccatgatggaaaaaaatattttctaaactcagaaaggtaagtatggaaaagtttgtttttaaaagtggataaatatatagatcttcgtttttcgctgaaatattttttgaaaatatctttaagctaaatgtgctcataaattgtaattcgggagaatatactggatttatttcgaagtatggagaagggtcgataaaaatttgattgtcaattgtctgttcaaaaagtgataataaatgctgattagatgccgtgtaatatgtatagcagaaatccatttttaaaagtctatctaagaaattgtcattggggaaaataatatcgtcgtatgtgaaaatttgcataaaccacctataaactttttgatataattcatctatcagctccgctatgagtctacagttttttatcgattcacagtcttgaattaagttattaatttttatcaaattttgctgaataatgacatatttaactgatttttctgtgggtttgtcatagatcattgtttcttgacgtagaagtttaccaataggcgatgccaattccgccttgaatacttgaatggattcaataagtttttcaaattgataaaggacttctgcattatttaagttttgtaatttagacgttgattggaatgttctgtggaaaatttttaattctctacatagtgtttcagctattgaaaatcttttggcaaatcctagagtactataatttaatatataaaacaccatatgatttttaataaagttgaaatgataattgtgtattggtaataatttcgcaaatgacaatatcttatctgctgtgatactttcagccgcaagagaaaaaatttcaattttcgctgttatagttaagaatgtattatcggacacatctgttttaagtaaattcaatattgactcaaattgtaaatttgtacaatccatttcgcttgcgaacaatggaaatgcttcaaaaaaggaaacatcagacaattgatgaaacttccttaaataatctcattgaaaatgagaaaaaaaagatcaaaagtttgctagcttttggtgttcccaaagagtgtgtgctttcgcgaagttttactccttgcgaacttttaggacctgaacgagaccatttaggaatgcttatgttcagacttgaaacagacgcggagagtccaaaatttttgttgattagtgtattgtttttagccatgaatgccttcaatgtgtctttctgcacgaggacttctttagctaatctgtataaaacttcattagttgacagtatcaacacaatgttagatagttgttcttacttagaagaaaaggtgtctttgtttggagtaactaattatatctctcaagggactaattgtctaatatcctgtgtaatgcaaggtcatgtatatgacgtaagaaaggaaaatatatatggattggtcatattgaaagatttattattggaacctgactgggaaccaagacaaaatgcaattcagtacatttacctctgttatatctataggcaagcatttaataaaatagaatacgggatctacattgttttatctgagctgacacatgaagaagtattgatagatttattaagaaacaagttttccaaagaacgatttatgtttatgaactatttgatcaacggtgatggaaatctaaactattttggaagccttcaacgaattggtcattgtaaaacccaaaacataaaatcaggaattttagacttacagggtatctcattaaccattataagactcaaagacgtctttgtcgaattgtgtgaaagaaaaattttcttgtgattatggatcctaacaataaagtttccataaataaaaacatgggtctcttgaggaaatgtctttgtcatgatgaatataacaaaaaacggttttgctattcacgcttccatcacaaaactcttctttataagcagttatatgaaatttcaaaaattctccggcgcttaaattcgggcttagatatgtggtgcttacgtgatgccataatttcagcactgggagcaatgcatgatgcaccgcacgttgatcgtttgttaggccagttctatctcaaaacaaactctgcttcggaatttgattccatctcacttattttagaaagtgaaaatattttacaaaaagaattgattgaatttgtacgtgactccaaagtagaacttgaaaaaatcttgcaagcagctatccatgtctggagagcgaagttttcaccaggagtattagctgcatcgagatttctcgatgagatttcaaattcatttaacggaatcgaagaaaacatcccaacgatttttctaagaatcagtgtgacattggccagtcaaataaaaaaaatcgaatatttacaaaaaagttttgttagtcacaaatgccctctagtggaagaaattttgattttattgtataagagagtttgtatgttaccttttccttgtatgagtaatttgggtttagtgtctgaaaaaaagagtgtttttgacactgtctttcataatgtgagtaacttttctctggaagattttttggacattaacagtggttttttcttgcctgcgatgttaaatggatcatatgttagtgtaaatctgactcgttatcactacgaggcagagtctcttatggaattgctattgtctcagttacaaattgtagagaaggacacaaataaaacaactggtctaacaatttatcttgaaatttggcacctgtcattattaatgtggctggacttctgtgaaattttgccaacaactgttcaagtcaagttttgtctaatactgccagaaatttttatggaacggctgaaaactgaaaattcttattggtcagttttccacaaagctctggcaattaatttagggttatatgatgaatctgattttacaagtaaatatcttgaatgtgaacgcaccgctgaacatgccagaatcaaaactgaaacgttgctggataatatttgtcgctgcctacgcagaggacagatgggattcatctttaggaaaaatatacataagtactccatgttacctcaaatagcttcctactgtcttggaaattctatggatgtaattccttttgaatatggcctgaatacagctttcagaattgccttaaatctttcttattttgtcgaaaacgtttcagaagaacaaaagtcccatactaacatagatatgtttcattatagagataaaattttcaatttaaagaaaatgagaaaaacagtgactgagttagttttgattgggaatgctgttatagattatgctttggaaaatagggattttttaatggatggaatagtcaatgcaagaagcttggctatctgtgttactggattacattcagcattaatgtcaatgaatctgccatttaattctcaacttggatgccaattatatcgaatagtatgcgagaacatttactattctagtgttagaacaagtatgaattgttgcaaaaaaggagcggaaccttgcagtttttttcaaagatccaaatatgcacaagggattttgcactgcgatttgtatgataatgttgaatatacattaccaaatgttttatggacgaatttaagaagcgacataaaaaaatatgggcttagaaatctaacctttgtgtctggttcggccatgtcaaaagagttcgatttgttaaattgctcacaatctttttgtcccatagagggaaataagattttaaagcgatctagtataaaagttttgcatcctaatcctgttttccatagtgatctgtctgtctattctactgaattacagacattatacataccagtgtacaatggcctgttcttaaacagatttaaaaaccatttagagtacttaagctctgtaaattatgatgtgtccaaagtcaacaaaaatttattttccgaagaagaaatgcaggaaatgacaatttttctcaatgcttttgactattctgtgaatgaaatgctaaatatgtacgtcggtgcgttgccgtttacagatcatggacaagcaaatgtatttttcataaataagacagaaaatatgagggacattttagtatgtttgtatcaaaatgggtttaaaacaggaatttatcaagctgtgtataaaaatcaaaagtgtgacggtgtcaatccatcaaaaaaatttgatttgctgagtggtttttctgatggtgtggtgatgagtactatgcatgtatttcagtgatgtaataaaaatttggcgccaaaaaaacacagtatataatggtttgaatatctctgtgattttttagtattctcatacaactcttcctgttaatatctatttttggtgcagcatggatcgtagcaacagagaacaccatagtcaccgagatcatcgcgaacatcgagattccaaagagcctcccaccatggcttttcacatgaaaacttggaaaacaatcaataagcctctaagagcttttgcaaagcttttgcgagaaaatactacagttacttttactcctcaaccggcaatcataattcaatctgcaaaaaaccatttggttttaaagctgattattcatgcagaatgtttatatataaccgatacagatcatttttcgactaaaacgataaataactttgttccattatttgatagttttatgggcattatatcaaatcctgatgtcactaaactgtatattcaacatgatagcgatctctatacgcggtttttagtcacggcatcagatatttgtgcacaagcatctattccttgtgtcaatggtcaagaaattgtaagagaaagcggaaaatctgcacttcgaatagacttggaccattcaactgtaacggagattttaaaatggcttgctccggtcacaaagaacaaacgcagtaataaaaatgaaatgacgttggcacaaatagttgtgcaagttaacccgccaagtataaaatttctaaccgacttaaacgaaatagaatttgctcatagcgggaaagttgtgtttcacgacgcaaaatgcatgagacttgtactatcttccaaaaatctacagcaagcatttagtacttgtgcagttttaaagtcttcgtgtagtcttagagcaatagctggcaaagaatacaaattatttttaatcgctaaaaatgtttttctgaccgtagaagcttatttaagtcaagagcaggttaaagacgacccaaaatttgaacgtcaagcaaaaacagaggaaaaaggagagaaaaatcacaaggtggaggaaggaaataattttttttgtaaacaggaaacgcaacacaaaattacaagttacatggtgcccactaaaaatggtggcacaggaacaaatttttttaatgagaaagaggacagcgaaagtgacgattctgcacattttgactataccccaaattcgaaaagacaaagatgtggaatgtaatcataagtttttctatgggccttgttttagggaatgtaattccgggagaaagctgtttccatcttatgataaagaaaacgctgtttgaacaagtagtgctaatattcctttttagcggaggtttgctattgacttaccgtcgggtgaatttgtttaactattgtcctttcaacgatctcaaaattataactttatcattactcgtgttgcaaatcaccgatgaattttttttggtaatctgctcgtttttatttttttctgaaatccgcttgagagccatagtctgtagatgcatgctaatatttccaacgcattcaatggcatcttatttcggcaccctaattgccattgtgttaaaaatatcagatttggttcattacagattgcttgttacagtgtttctgataacgccatatgtaaccagttataagtttctggttaactctcatcagtttgccatgtgtcttcagcgatacaaaccgatctataaaccgaatggcccgtaccaaatggctataaaagatgttattgtttatttgctgcaatttttaaccttaacgctgctggtttggtttggaaaattgtatttaccaagaaaaagttgccagcatttatttttcttggcagtcttacatagtaatttgtttatcactaaactatatcaacttgttctgtgtagtattctgtgtttgttagcaggggtaataacagaacattgtttcttttcattgttgtttgagttctttcttggcttaggttatagcgctctatttgctcaaatttcaaaaacagtgggtagaaaagatatttttacaggcgatttgttgaaccttttttattgttcagcttgctttgtaatttttttctaaagaaaatttgcagcttctaaatgtgctaaataaaaaaaattgaaatatttatgcctttgttttttcttgggtaattttaaaactgaagcatggatttcttagcgaatttgtgctgtgtcaataaacttactcttctcgaagaattcatcttaagtaaggaaggtacatctttcgtattgcctttcccagaagaatggcgagttacatttcactcattagaaacaatcccagaaatttcaaaggaagacatcgaagaaattcgaaacacttacttgtgttgtgaaaaaacgttgatcgttgttggtgtgttacatcatgttaaaaaatcaacttgcagaggaccaattcttttacaaggtgacagagggcatttgtatgtctacaatggtttttttgacaaaagtctttactatgtttcatcaaacttacaagatttctttttagtaggattgaagtttttctaccccatctacgaattgtgtgattttatcgtggactttgaaactggtagcaaaatcgtggagcatagcaaatctttctctgatatgatcatttatagggatgaaaatataaacgtttgttttatattgaaaagtagtccttataaaacatacacacgattttgcagacttcccatgacaccttatactgatcaagaccttcaccgttggaaaagggtcattcgttgcaacattgtagatgttcttttttgtgtaaaacacaacgtttttgggaagtggtttgaacttgtgataatattcgatgtgaatgggaaaatttttggtgtagatgatgaacaaatcatttttctcgcacataacataactgaatttttgaaaatcggttgtttacgatttaatgaaaatcgtcgactacatgggtattggtttgaaagaacaaacgatgttagaaatgtggaagaagagctttcacggcagatcaactgtccatggggaaatacttgtaaaaggaaaaaaaggaacatatttaaacaaccattactatggaaaagtgttggtagaaaaaataattctgcacataatgttttataagtacaaccattttttcccagagacctatgaagattgttggaaagggatttattatttgtttgttctgtttattttggcttgcattgcatatcatgattatataagtccttcaatagcagagaatatgttatcatttatcaggtgctctaaatatccctagaagatgactcatgagacaccgccaccttcttataatgatgtaatgttgcaaatgttccacgatcattccgtttttttgcatcaggaaaatctatcaccaagaacaataaattcaacttctagttctgaaatcaaaaatgtgcgccgaagagggacttttataatactggcatgtctcataatatcggttatcttatgtctgattcttattctacacatcttcaatgttcgatatgggggtacgaagccctgaattttacaccgattccagcacttttttgcgttgcttaaaaacagtaatttagtcggcacacgtacaatattaaactaggcttcttctaattgcgcagtgtttaaaatgttatttggaattttattttttttagaaatggttacctttgttaacatgagtactgtttctagtacgcccactctggaaatgtcaagaacttcagattttagttccacgtcaatcacatcagatacagagagtacgagcgatttaatgtctgtgtctatgagtatacctacgactatcgcaacaactaaagagaatgtcgaatctacatccttaaattttacaaagacctcgacattctccagtggcagtactactaatcatgaaaacagtgggaatgcatctgaatttttcacactgacaatttcaactccagaactgacaaaacctcaacttttgaatagccctttaaaaaagttcgttttgttccttgtgattttaattgcagcagttagttttattggtattgtagcgttagcgttgttagttttactaattaaaaaccccaaacgcaaccattctaagaaaccgaaaaatgcatacaataaccaagcctttattggtgtctgggattaataaatgtttttttgggcaaagttctccttgttgtgttttatctaccatcaacgcatgatctccgttgaaagcgtttcactgggaagtatgtttcatcaatgttttcattttttgagggtaattaaaggaaataaacaaaattctggcgtaaatacagctcatgtaattaggaatcagaccagcacaaatgtcttatcctgttgtggaatcctatgactgagaaaaacagacttattatgttagatgtgctttgctaaccactgtgtcatcacagaaagatcaatgcacacatttttgcggaacccctaacgtttatcaccgtaaaatgggcgtaactgtgacgttcagtcgtcaaatatatattaagaaataaaagctttctttctcatcactcttttctaattcaacatgtggactatcttgctgttttgcgttcctgtgatttatggagaactctatccggatttctgtcccttagcagttgtggattttgatgtgaatgctacagtggatgatttgctattgttcgacatatctttgagcaaacaatgttcagacgataaaatcagacactctgcagtcgcggcaatgacagacaatgctttcttttttggcaacagcgaaacgcaaattgaaaccgattttggcaaatatttggctttcaactgttatcaagtattttctacactaaatcattttttgtttaagaactttaaaaaaacaaaaggactgatgaagcgatatgataaactctgtcttgatgtcgagtcttacattcatattcaaattatctgttcaccctttaaaagttttatccgtctgagacgtatgaatgaaactggaatttctcctagaattcttgaaaccacattctacttgcaaaataaaagaaacagcacgtgggtagcgattaaaaactatttaggtgaagatgatcccttcacttatcgaatttggcacactttgacacacgctaaaaactttctgatcaattcttgtgaaaatgacttcaatcaactttttttttggcaaagaaagtacctatcactcgcgaaaacattcgaagctacatttaagcaaggctttaatcctatgattgaacaaagaaatgaacaacgatatagaactaataacatagattgttcattttcgaaatttagacagaatggtgtaaaggtagcagtttgtaaatatacaggatggggtgttagcggtttcggctccttagaagttctgcaaaagataaaaagtccgtttggagaagagtggaaaagagttggtttcaactctacgggtgcttttactcctttgtatggtagtgatgtgctttggggtctaatttttctaagagtagaaatgaccacatatgtttgtacctgtacgaataagaacacaggaacacaaatacaggtaacattacctgatgtggatttggatctattagatagtgaaaaaacgtctagtaatgttttcgtagacatgctttgctacacattgattgctatattattccttgcatttgttacagcggtagttttattaggagtttcctgtttagacggtgttcagaaagttctgacgtggcctttacagcacatacaaaaagaaccagtatcagagaaaataatcaatctaacaaacttgatgtttggacaagaaccgttacctaaaaaagaatctctcaaacagcaatgtttgtgaaaaaaacatgtcttttagttttcattgtacattttaccaaatatgtggcacataagttgacaatgtcaataatcaataaagaacatcttgagaaatatgaattgatgatggataactatgaactggcacattataagaatctgtctgtcggcaatactagtatttcgtctttcctcacagattttccaacgaaatttaatgctttgtcttacgtcttttctaccaacaaggacgaatctacattaaacagcattttctcttattttgtctggtcacataggaatcgcagtgttcattatcaccacaattttaacgctgaattcatttgtgaaattgacaccgttttgaaaagtcattatttgttaaaagttcataatgacacgacactgaatgtcaacctgttggatttttctagcagtggttttgacgaaaacatgtatgctaatgttgaattattacttattctcaaattttatgtgcagcagttttgtgttaaacaactcgcagatttttctgcacatgtgaccttcggtcaagatggatatcggccacctgtggtgtccatcacaaaacgtggatctaacataacgtgttcggcgcagctttatagtccactgggattgagtattcaatggaagctagaaaataaactggttcctgatgatttgacagaagaatatttggcatcggacatcttaaaagggaaaaaattctactttttttttaaatctattaacacggagtccgctaattatcaatgtgtggtaattcatcaaaaatgtaattactcttttaacgtccttgaatttaataattcagatgaatattttcaaaatttgtttcacaaaacttacaaacacgggaattactttgaagttttttggatacttttaatcattcctatacttgcctttattttttctataatcactgttaaaaaaatgttttttgaaatttggctgcatgttatggctgttcttaataagcgtaaggaccttgatagatctgatagtgttaaagtaatcatggaaattgatccctgtgattatatatctgtggaaaatttgtgtgcaactgaaaaaatggaaatttcagattcagactgcctgtctaaggattctccagatcttcaaattcacgggaccttagatttcatgtgtcattaatgagtttcaataaaaagtttgctttttgaagtgtttttattaatttccacgcccatatccggggggttgaatatatacgcttaaaattcagtattttttatgaagagacgattatgtctaaggaatgtggcttaacgacgatgctgcgctgcaaagaaaaattaattgcagcttcgaaagatttaaagttttttgaaaaaacagttcaagaaataatgaaggatggcgtgtccattcaacacataatgtgtatcaatattcgaatttgtgatatgactgacattcttccagaaaggagacttaaacgtttagttaacatcggattttatccatttgagggaaagatggtgatgtttggggttgccgaagaatgggtgtcagcttctgggacgccgcgaagacaaatagtttttttactgtccttgtctcagcatgtgtttgcttatgaagatggtgtgatgttctatttatcgcccacatttgaagatttctggaccacgaaattggaatttagctgtcaaaatgcaattacacatggcatgtcaaagaagatgtcgagagatgaatgccatgaaagatttatcaattactatcatcgaatacgacaaaaaacaatcaatattagtggaaaactacctgcgcgatttcaaagagttcttcctggtcacaagctttcgaatgatagagagacacaggcagaaaaaatgtatatgtccataggatactcagaaaatgacaatcttccaaataattgcaagatttacaaaatgtgtcatacacctggtgtgacaattttagtgtccagatctacgcaaacgggactcggacattttactcgcagtactcaaacatcacaaaatgacattttttttaaagaacggtgttacaaaccgcaaaccacagcggaaatgtatccctataaagaggtaaacacagctaacgagacagagacagcacctttagatatgctagaagagagttcaaacttctcattggaaacctatgaagaaatagcaaactcgccactgaaaaacttggaacacacttcaacttcgggtttcccggtgaatttcgaacaatttaccgagtaggtgccttattgttttttacttattttaaatttttcgctgtctttaactgataatttcttttttatggccatttaaagggggaaagaacaagatagcagaatatcaaccattcaaaaactccctgagcctgcgtttgaatgtatgtccactaagacggaacttctttcttcaacacaattttcacatctagagtatcttttcaaaggaaaaatttcttcggggtatgtatggcaatgcattggaaaaatgctgcaatgttcatcaatagttaattgtgtttttttttgttttatagaagtaccgtggactttcttgaagaaattgtgaagtctttataaaggaccatgggaaaagagatgatgttttttgtctttttgatttgcttatctctcacactcatgtcaaatttgaaatgtcaccagaatataatatttctagataataaattagaagctgtttgtgtcaccacgtgttatgttaatgaaatgctaatagggaattctagttgtttatctgtaagaacagcttttctgatttctttgtctttaaaaactgaaggatttcgcgaaatgagtctagtaaatcttactacaacatctcataaattaacctatttgagagtgctgatcaattattactttagaggagttatgttaagagcactaattgccaaaaaatggcactttgcttctcgggctaacagtacacttgaatgttggttagaaggtcataattcgggtggttccatcactattatgacagggggtcaaaagtttcttttgcagctaagatctggcatagttgcagttaagtggagaagcgtcggaaaagataaaaacaaaacacttgaaattctaaatcaaaaatttaattatgattgttatttcgtagcaatgatatgtcctcatttatctgatgaaatatatcaaaggaaagtcttaaatccaaactttacaatagtacgcaatgaaactatttataaaagatttttgcgcaaaacttggaagtcatcgtggcttgattggtacaagtacaaagaattggaagatctcagcgcttcatatggaggtaaaaatgtcatcttcttgaatgattacgaaagcttcctcgatcaaacccaagcgacaactattggtgtagtgtttcttgtcggcggatcagcaatggtactttttttgtttttctgtttgtcgatagtaaatcggcgcaaagttgacaagaatgttggttgatttattctcgattatcatcaggaatcttttttgaacacttttacgtgactgtcaggctcatttcaatttctgtctttgcaagtctttgctggatcatagagaaaacattgtgagtttctacatgtttaacaaacaataaattttgaatgtttacatgtaattcgcttacctttttgtttttgaataacgtcataatcatctttcttatatctgagagaacctgaaagaaaataatttttttttgagtgtgcaatggtcactgagccatcaaaaaatttaaaccgagtgtaatctagaactgttaaaatctgttccccccgcggtccatttttactcaatataaagaagaggtaagtgtaagctttttcttccgcattttgtattaaaggaaacatttctaagtttgatcagttaacgctgattaaaaacaaaatgtacccgaatataactcgatgtcacagcgactctcctgtctttgtattccatattaaaagtaatgtttccaagttcgttacgatctcgattaaagtatcgaagacatacggtgatcttaatagccatattttagtatgtcaactgcagctctgaaaatgtgtatattcgattcggcgttaatgatgctgcatggaaaagtaggaatttatatatcatatattttggaatttcccagatttccatactggaattcacggacatgatttctagtatcaggcagcatttacaggaaaaggaaatccctattgtaaacagacttgtttaagatagctgtatattttcagaactttccagcttaagcataaagcgacgtcatgcttcagtaatatataaaaacctagtcacaactgctgttttcataagcttagagtgtgcttcaacatggccgaaagtgaacaaaaagttcgatttaggcatgcactcgcaaatttaagccttgttaaacaagccttttatcgcgattctcttagtgacttcgttactcaaaatagtgggtgtgaaatcttcataagatggcctcagagtaggaaaataatcatttcgcctttgcgggatatgcctttcagaactactagtgaaaccgagctgcaagacctatgtaagttgcaaaagcagtcaaaacatttccaatgtgtcatgatgttctaataagtttttgttgttttcataggttgctatctcctatgttgcaatgaaaggttacaagtcatcggttttctgagtgctaaaaacgacgtaacaacagcagctgctaaaaccatcattcttctcggagaagaagagcgtttctatgctttggacttcgaaaaagaaaatttatatttgcttgctgaatcaacagagcgctttgcttatttcgggttgcaccgttttgatccgatttatcaagatagtgacattcccttcctaacgtctatcgatcacgttttgcaaagtctcattcatgcacagtataatcttgtgaagtttgctgaaataatagcggctaacagtgggaaagtgtacactcttcgtttgaagagggaaaagatggatgaaaaactagttttgtttctaaccagaaaagaagaattccctaatcgcacagaatggaattttctagctgacgtttatgacaatatgccatactatggacatatcattggcagcgtcggtaaaaacttaatgtttcctaaaagtttatttttaatgatggatttaaaaggttttatttatggtattgacgcaattggaaccgggatcggtccctgtgtcaaaattgcagaaaattttgaatgtttattaagacaggggatagttagaacatatcgcacatacaaattttttccaaggaatttaacaattactcatgaaatttatccgacctgcccacacgctgccggattagctatatatttaagtgaggatttcagagaagtggatacatctgatgaagacgaaatttaacccggtcaaaatgtgccaataaaaatcgttaaaaacgaacactttctaataacggttaatctttttttggttctgtgtggttacataaaaatttcctttgggggtttttataggcggtgtgccagtaaaagagttttttaagcgttcgcctaaaaaaattcatttagttagtgttcttctacgagggtagactcttctttgtgagaaatggaaacctggagaagacaacgactacaggaatttcgcgagctgtgtccactacagatattgatgacgttatctaatattatatctaaagtggagacaatctatataaaatatctttttcaaatggattttaatacaacatatagatttattttttctggattaacattaaccacaactgtgacaaagtctgtagtgattgaagctttgtttattattaagagatggcaagaaatcaagcagattttcaatctagatgttcacaaaactgaggattgttatatcgtcgctcaattcacacacatacctgtaaaacggtgagtccacctctattatttctacacaaacgagtttcaaaattttattgtctaaccccgctcttttattttcaggaaaatcacagcattattgtatatgatgacaacaaagcatgaaaagcaacttttcttaaacatgatttatgcggtaagaaaaatcatttttaaaaataataaatgttcttctgtaaaagatcttttaactttttttttctttagtttctagaagaaagtcatctgaggcttggagacgatgagcatgaaaacgcgataatgtttttttcatacatagaacgactccaactgaccagagatgttttaattgagattattcaaaagctaaaaaacgtggaaattaatcaaacaattgcccttgtgttgtcatacaatgaattagctaaataaaaaacaattaattattcggtgtcttcttgcatttccgagacagagtcaaaaagattaaatgggctatttgtcggtgaatgtagaagttgatcgtctgttgaaacatagctagaaattgaatagatggattggggtgattgtggggcattcattgagtcttcatccgtggaatctatagtttgtatttcattgtccccatggctttgctgtcttggagtattaccatttatggaaataggcgaattggtgctcaaacgttcttggtcattaaaaaaaccaggaacagattctccagaaattatactagcagatctcgaacttctttctattggagttgcactcctagaaacacggaacgttggggatgttctattctcatagatttcagaatttccagaaggggtagcacttctagatcttgaaatctctaaaaccggagttatacttctaggtgtgttattcccatatcttgcagagttcccagagggtgtagtgcttcctggtctggatatatttagaactggagttgtatgaatagaattagaattccgcgcgggtgtagagtttccagatgatagatcaggattgtagacgtttaagcgctctacgtattcttttaaaggcaaatcatatttttgagctattgcgctatacacaaataaatttgtatgtgccaattcagtttcaagaacttgtatgtttgagttgttgacatctataattttgtcatgtgaaattggcattaatgcgatttctgaaaaggcgttttccggtttcacattaaaaaaatctgattccattaaaatgttgtccactctgtctggatctacttgtcgtggaggtttatcttcatcatattcatcatcagattccttggaagatgttagtatgaaagtcacatcttccgcatgtctgtttgaacttaaaacgttttcaaacgaaataagttggcttttgacaaaagaaggcaaaatacaaatatatgatttcgtgacaaaaattccgatttcaaaaaatttgttgataattagtttaaaatgggggctgtaatcatcatttggttttaaaagattcatgttggcaatcaaagcgcttaaatcaagtgtcatttcttttaaatctggtaactgaaaggctgcaagcacaacattctccattaaagagtttatttcaaatgttatccaactaaagagtcttctttgttcttttttatagttgatgatcatattccatgcagaaactagaaataacacgtcattataaatagctttcaatgaaaaatcattacgagatgtgaataataaagtaggttgtctttggattccaatcgaaagatcttttatattttcattatataaatcaactccagcttttagtgtgtacttaggtattttaattaggtagttgtagatttttaatttctcgttgtagctttctatatcattgtctggttgattatcaaaagaatttccagctctgtaaatcatttttagagcattcataaattttgaatctggaagaccattctcatgcatcgataaagctatgtttgtcatgtaagtattggtttgctcattagaaaatagaatcatcaatgcttcatcgaatcgtcgcatagcctcttcggtgttaaacaagcttttcataatttctatcatggttttcagctgtttcttccctgtgtggaacctattgatatgaacagctaatcgaattactgggaataaaaaatcacgcgagcgagaaaacttgaactttgttataagaaccataatttgttcaagcgtttgaataggcatgggaataaaactgtttgcccaactaacagagttgtaggaatcggcaattaagacatctttaagaaatttagtatgtatacgaggtaatatttcaggcacaaagttgcagttttcgtcagtgacaaaaaatggaatcgaaaatcctttttgctgttccattgtgtctgcgttcagcggatccgttcagactgtttcagaacgtacaattcagctactttaaatattgttataaaaatggtgacgaacgaacttcgtcgtctgagtcataaaacatgaaatctggcttaatggaatatgctctaatgctatcggatgtcttcttttcaattttttcctgacatcgaatgcaatgcatgaaagaccttgatagaacaaaatctttgactgcaatgtaattatgatctctgagtacaactttcttatcggctattttaaaagtaggctgcattgtaaaattcgatgcaagtactggatcgttagctgtaattagtctgcaattagatggctgttgattcaaagtcatagcctgaaaagcttaggataaattgattttaaattttatttaaaatcacaaaaaattttcaaagttttaagcaagcttcactgttcaattttttattgtcagaggatttctctttctctttaaagatgaattacacaaattacatttaatgaaatcgtaaaatcgtaatcggaaatctgttctagtgaatgcatatactagcggattagacaagcagtgtatttctggcattaatctagatattatttgcacaatttctctttgtatggtgcctaagcaggaagtatttgctatatacaaaaaaaaaatttccacagacattactaggagatttggtatttgaatacataaaaaggatagtatcagtaagctaatgaatgacagagttttgttatgtttactttgggtcaaggcacgcaaggtcttaccaaaaatcacataaaaatagctgaaaatgacagttggaaaaattccccagagaaaacaatagacaattttaattcctataaacaagtcatatgctttttgcgttgagatgtgtatattacattttccataattgccttttttcttttccacttgaacatataatactgctggaatggcacacatggcagaagacagaaataaaattccaacgttccttttaatatgattattgtttttgtcgtttaatgtccttctttgcagggttcgatagcgtattgtggatattactgctagcatgcacagactgtatgtgcaggacgcactgtatacaaaaagcacacattgacacaaagcctgattaaggtttgtgagagcttctcggttcaatgtgagaagtaacacagtcaatgaatgtaaagaatcactaataaagagtgtgataagatatggagaagtaattgtctgttttgtccatttgtagtagattagcagagtgcatatgacaacagtactaacaggaagtatcagcgttagcataattccgttaattacgctttcaagtctttgggctttccgtactgttggcgtaatacacgtataattgtacttgtactcttcatcatgctgtgaaaaaaagttttgcaagatgattaaaaatgcaaaggtaacatttttagcaaagctgtagcaaatcataacattagattatcataccaggattttttggaaatcaattagagtgtccatgtcggcagcgcatgtatctaatcaaagagaaaatagagactattaaactaattttttaagaagtgttcaataatgctcaacagaaaaaacgagtcatgaaaatgtcacatttaccctttgcttggatttcggatgaagcaaagtgttttttatctcgattttttgaaaacatatcgtctttaccagttgttgatattcgcgaaaatccatggattttgagtcaatgtatcgttaaaactggaaattccattaacaatgtaaaaacactttacaacaatttgattctttggatttattttcatcaaaccttgtgtaaaaagaaaccagactatgaggaagtttggcaagaaatactaaaggtgcaaaaaattctgaaagattacttagagcaaagacagatgattactgattattctagtttaacatcttttaacaaagttggctttgaaacagaatttaaaaacgtagcaaaagatttgcttaaactgggcagttttcttcgttggggcactgtgacacacgcagccgattacgtcaatcttaccacagaagaaagagcggaaattggcgagaatttacaaaaggcaaaaaacaatatgctttctttcacaatttaccaaatagttgatccgtggaatgaaaatggctactatgttactaacatcaatcgattgctttatcttgggaatttattaattacattacatggatcctggatgaacatggagaaactcgcattaaataccattaatgaaaagaaaaatgcaattttaaaggcgattgaaaacaacaaaaattttgtttcgatatattcttatcaaattttaagtttgccattaactagtcatagagtaacttctttttttaaaattttaaccgaagactttgatgttataacaaaaagtcttgagttacatgctcttcccgtaaagagtacatgggatgatcgtgtaaaatttactcctgaaccgattcagacattcaaagttttaacagatttgtcgaaatcgtctttaagcaatcaatttgagagtagttctaaaaaaacttcgcatggttcatcatttaatccagaaccatttataaaaactgaacaacggagtaacaacacgctatccaaagatttatttgtaggctctgaagatgggttgttatcctcggtaaaaaaggattccatgatattggacgagccaagaaattccacgtctataaacaattctaaaaaaatgcacagaatactacagactgaaatacttgatttaactgatcaaactatgcacagaccagaggacaaagtaaaccaattcaatgaaattgctgtggcaccagacggtattaaccaagttatagataccttgagcaaactagatctacacaactcaaacaaagtaatagacattgttagctcaccaaaagttaacgtagttcagctacccaaaaataaaattgattatcactctaccttttttctgccagaaaacgaagtaaacagacaaaacggagtgcaatcacgcgatcaactgtctaaaaactcgaccaatgacttgcagaaaattttggagctacgagaacgaatcaaaacaattaaacaaaataatgaagacattttcaaacttccttcagaaaaacgcagaaaagaaattgtccacgagaacttacaaagttttgacgatgagcataatgaaatgtcattgcctccacaagatcaaaaaagcattaagcaaaaaaatggaaataaagcaaattcttccaccaagactttaaatatgataggtactaatgacgtaaacgcttcaatgaaggaaaaagagagtgcttcttcagctaaaaaaaatcaattagtcaaagatgtgaagtggactccgagttcttcattactggatcttagtagaaggaacgatcttcttcaaaaagaactttttgaatcaggactaggtgaaaaagttaagaaattattaacggattttacggatacaattagtttagaagagcgaagcttaaaagacgtactcgaacccccgaaaaaaacagatgtttctaacattgcgactttcaatgacaacaacctgaagaatttactgaactccagaaagagagatcctttatttcaaaattttagcttcactgaaaagatgcagcctgtgcggtctccattttttttaccaaatgctgaaatccaggattttgattcaggttcacttttaacaggcaaagagacgcaaaataccattttcggtgctagcaaggctcaagaaaatggcgataaagatttaatcgatcttgaaaattctgttcaaaaagatgatgatatagttaataaactagtatcgcatttaacacactcagaagaagacgtcgtctaaaacacagttgaataaagattagctattataatgtaagaaattttcttttggaaggtttacgtttcctattcgggtaatgtctttattaatttttaattcttgatcccgtaaagaattttttcctgttgtcattttttccatatataagagaattgcaataggggtgccttgcggtagcactagattttttgaaaaagatttaataacaatttgaagaggagaattctgtacccatgggcacatttgtacttcaaagtagccttcattaggatagcttgacaccaacatctgtctatcatttctggatgaaaactgaattggtaatgttactatatgaaaacagctgggatagaaatgtaaattatgtggtgcgtacactgtaagctcataatgattaggactatgttgtaaatttatagcgctgttcagaatatctcctgtgaaaaacaatttgggattgcaagaaaacagtagatgatcaggatttgcgagagttgaaaccaattcgaactgaataactagatagtttgggagattctctggagacaagtttggtggcatctgatcacaagaaaccgtggaaagagagcccaaaattttattgtccctagtaaggtttatattttgtatgttaatggagaattcaaaatcctgaatagaaaaccgtgtgttattaaaaagtctcaatgcaaaagcttctggaatttgtatccctaaccagtttccaacgaacattgctttcaggataaaattcttgttatccctctgacttttccatgacagatcccgtataattcccaaaaataaaaaattccgctgttttataatttggattgatccatattcacttgttacctcgtatgttcgaagtgtcgaaaagtctacgtaagtcattgggaatttatatggaataaatggtaacatatagattgttgaagatacgccagtgagggcgtatgcacaacttaaactcaatggaaagctaaaactcccagataaccatcctcctttagtaacagctggattgagagttatgttttccgactctggtgacgcgacaataaaatataattctttagtcgaaaatatttttggcaaagtaatgctcgtccaactatagatctgctgtttcgatgtaatttgttgattcagatcgataattaaagtatttagttcgattaagccattgtggtaaagtatcgttcctttcggtggtaaaaaacattgctcatattgatgaatgataaattttaataactccacataaaaagagagatgtctacgcatgtagattataggatttttttgtatggaagcgatggattttccaagattgacatttatttcgaacgctccgctttctgctatagccatttttaagtgtagttacttagggcgaaaagggattttcctttcagtggcagattctgagtttgtaatattaatgacactgtttgttttgtattgttaccgtgaatgttctaaaaatcgatctttaaaaaaggtaaaaatccgattcctactttcgacaagaggtttttaatccgataacaccaggcttatggttttaatcactctaatgtttcctgtaatgggaaataaaaaatctgcaaagctttaaaatttatttcctgtcatgtgatttttttctcttatatttatctggttgagtttttgagaaatggatgagaatacaaacttcttaccacattcacttcaatgaaaaattttgagacgatggcagaacaatataaaactttgccttgtgttggacaactaaatgatggattgttaagggaattgaagaatttatgtcgttttactgatttccctggaattcgccttcttactgaacgacatcgaaatgaatgcttgtctttgatttggccaaagaatttgtggttaaggcttgcacagccagttgacgttgctggttactcagaacaacaattggcagaactgaatgaccattaccaaggatttaaggaaaatttgtgcttgattggagcgattcaaattggaaggaaagacgtgccaatttttgtgggaaaatcgagtcgaattttttgtcacgatttggaggatgatgttttgtattacatagctgaagactttgacaaatttgttagatttggtattctaggtacaaatgtaatcacttgctcagaacctgtttatactcgcttttattatgatggtccaaagtttgaaaaattggagactcttaaagacttaggattattacaggaaccacttaatttgaattctagtctaagatttaacaggaaaacagctttggcactaaaagctttgaggagaaattatatttcaatgctctccgaattagatgaattggcaaggtgtaaaacgttagcagagattgaacacttcgtttctataaacactggtttaaaacttcgtttggaaactccaatctttacagcgttaatcctgcaagacaggaaaaacatacactgtggcacctcagaccaaaaaagatttgaagaacaagaggcactgtttgaaaaagtagttgttttaggttttttaaatatttcagccgaagactatggtttgagaccaattctatgcattggagaaacaggagcaatttattattatgattggattgataaagtgttgacgcggattgctgattgtttactgacttttgcaaggatcggcttcgcgagatattgtggagattttggttatgataaaattggaaaagtcactgccagatttggaagattatcaactcttggaagtgcaccggttcaacagtactcctggtatctaagtaagtaacagtactttttatggtttttaatttttctgaaagtgacggaagtactaatcacaagttaattttgcagaaattgttcctgtgtgcaatgatgtttgcattgaaccgactccggatttaccgtcttttgattttgccgttgagttgctgctgtcttcatatggagaaggcatggagatagttcgcaatggtataaagtgctgtcttgcttggccgccaaactatgtgcttatttttggcgaattttatcatttcaaatgtagacgtagtgtcatcacttatgattggagtaatttggtaggagcagacgaatttctttgcgctgttggttatgcacatccaaattaccgagaaccggacccggactttgatccatttgtgatgtactgctcatcaaataagatgcttgcattagatacggtcacagatgaattgtacatcatagcggaatctccagcacatttttgcagtatcgggctgagaaatttcccaccttttgcaaggattgaattagatattgagctagacagactgtggtacggagaaaccaaatgcagcggtgaggagttcgtactcttacaaaaaaatattccagccttaaagaattttgtcaatcgccaatgtggtcaaaaaattcgtatcgatgcttttcaaaattttgatttgtctttctgttcttcgaatgacatccattacatcacaggttctggtattctcgaaaaaatactaagaagaaagtatgttgtcataggaacttgcgcgagatgtcaggtagagccaaattgtagagctgtcatcctactaggtcccaattttcacatttatgtgtattgtgataacaagatcaacaaagttgcaaggtctattagagaatttatcaggcgagggtttgaagaactcttatacaaagaaagatatgccctgaactggcatgatgacagtttgatttatgtgagtgaaagtgaggcggaaaatttgaacagaatgttaaatggagagtctccgattcttcggaagaaaccacggcatatgtatccaaggtgtgataggtatgtaaagatcaaagttcttcttttcggtattctctacacaatactcttactgatggttccatggatgttctttttcagattattgaagaacatgccaagtattctgtttgcagtgcactcatctgaaatcagtaatcctcttgttcaaagtgttacaaagtttctacatccaatcatcattccaaacggagacacggaactgaagtacattgttccggtgacagaatccagactaatcaacggccttcaagcatcagctgctggacgctttggaataaaagggctaagattatgttcagatggtgtaatttggaataggttgatagactatgagtacgaaatgttcaagtatccatcaactttcacaagggctgataaatttcttttgcagttgcgcgatttaaaatttatggaagattttgaccccaaatggcagtgcattactaaacttgcagctgtagggttctattctggggcatcattgtttaatttgggtgctaagcctggaattggatactggtgtcgctacctatgtgagtacctttctatgttattttttaaactagatggaaaattgaaggaattgagtaaagaatctaagcagaagttagggggctttagctgtgcattttggagcgaatcttttaagacagaaatgcaaaacaaaacagaatcattcttcagacgcgatttttttgatcgttttcagttgtacttacttgagcactttttactattttgtggttgcgaagaatgtcgatacaattttttcaggtttaaaaatgtaggcacaatgaaaaagaatcctggctctgtcaaattacatttctttccagctttgggtaagatcgatttacctatttttccacatttatctgagaaatattctaatctttctatgtttgtagccaaagatttgtgtttaagttttattgaggggcagattgaacattccaggtttcctatctcggttactgtggatatgggtcaggacaaaagaaatctgttgaatattcttagtaacattgtgtttttgcttttcataattcaaactcttaacagtgttttgtttactgaactgaaaatgtattatgatgtgtacttagatgaattaaagaacttggagtctagcatggaatgtgaaatgaaactgggcagtaagggttgtatgaacaatatcgtttatttcaatatgttgaagcaggttaaagatattgtcagaaatcctggcacatcctcaaactttattttcaactgcttagaagtgataaagatgagctttgaaattccgtattacaaaaactatgatgaaacaaacttcatggaaagcttttatttgcatcatctttacatccaaaggcagcctgcgaagcacacggacttggttgctgcaaataatctagcaccaggtttcttcatagtgaatgctaaggaaaagagcttcatagatgtgctggagagatcgatcgtgaacatcgaagctgaatatttaagtaacacaaaaaacattaatggagcaatggcactttttttcagtggtctcaaatattttggaaattttgggaatggaaatttccagaccagtccagaaaaagatgtaagagctgtagggtataagctggggggtcttgacaagattcagaatgacttgtgttactttgccaatgtagaaacgttagcctgtgttggagtcgatgctagtgatggaaatgaataaacatttttgacaaggatttgcgtaatggatttaatcgattatgatgtttgtaaagggccgctaaggaatcgcattacgtatgttataccgaatcacccttatctgtcatggacggcatttaactcatgcgagttagacgtcaacttgaatgagctgacagaggagatgattgcggatagcggtcatctcacttcagaagatttgttccaaactcgaggcttaaaattttacgatgacagtctactatgggctgttttagtggagaaaaactccgtttcatttaaaaggagggacaaggcaacaatgactttagacggttttctcgcgtttcttcaaagtctaaggtttgaagagtgcacttctccgttttatcgagttctgactaaagctacagctttggctcattttacaatagcggaatattttgtagctggagaaaagcgcgacactctttcgtctcactttaatcgtttaatggagctcttagattcattgtttttacaattttttatgcttagaaatcgctgtgattcaaatatattgttgagtttgtttgagttacttccaaatccgaaggaaatagctggtgaagtcgtagcgccttccaatctcctattaaaaaatttcttagacgacaaaatctttttttcattcgtgatgaattatcactttgttgtatctaatctttgtagttgcggggaatgtcgcaaggcgctattttctcgttttttgaagcggagagaaaggggcgtcctacatttgtccgatatacaggactttagtccacaggacttgattctccagcaattacatttaactaatgatgaagctttacgcgttagagagagtattgacaaagatctcggcgcggagttaatactgaaagcaatggaatcgaaaacattgccaattctacatgatgaaattttagggaatagtcatctagaaagaaacattttaaagatttattgtaatatcattttatgtcttttcctggcgcgcagagtaagagaacgcatctctcgtgatttggacaaaatagcgcgttttttcgcgcagtctttagtctttttagaaataaggatactaccttttgaaggagttgaaaacgtttgtaggaagttagcagttttaggtagtcactttagcagtcacaatgtgatgtccattcctcggcactgttccgcttttcttgaagtggcttctattctagtagcttcctacagtaaacagaatcatagagtgagagctctcctagagcacttgtgtcaaaagaaggtagctttaacttgttcgtgctttcttttacacttagctcgggagttaaggcacgatattttggaaggatttacgaatcctttaaagctgcactacatggacaatccagtgcgtttttttcggtgtcaagattgcaatttatatgggacgcatctttggagtggtttgtttccaaacgtagtgccgcatgcggttaggggtggaggttcttttgaggttaggatctttgaacacaggatgcgacaaaggagagtttcggtgaggaaaaggctttttaaagagtctcagcaccgcggatttaccattcgccagtcgcgtcgcattccgcggttggctttctgcccttttgcgaaaccggtgcacaaagattattaatacgctaggtacgatttaagtatggcagatttggggtctgacttcaattttgaagagcgtgttttgagagttgtggcaaaagatttaaaaaaggaaaattcgtttatacgaaaatatgttgctcatgttgacgggaaaaaggatttgaaggttgccaacgttgagaaaacgtttttatctgataaaaaaagaaaagagaaaatctttgaatctgctaaggctaaactcgtggattttctacgtgtttatacaaattttaatagtctaaaaatgtttttgtttctgaatccgcatttgagggtgcctttggtttttccagaggggtttgaacttgttttgacttatggtgtggagggatatgaggaagataagctcaaaaagtacgccgcgttggtgtgttgtcctgaagaacttactgttcttggttacataaaacatactgtgacgactgtttacgaacttgagtatgagactgatgatgtggttatcttacttgggaaagttggccgcgtttatgcacatacaacgttatttcctgatcaactatgtcgcgtgggtgacactattgacagttttttgaggaaaggtctcaaaagatgtctgtacgcatacgttttgtgtaagtgtctgcaatttgaggtatcagatccagagattgaagctatcacaacatgcgctgaaattttggcatttcgggacaggcatcttggtgaaaaatttgagttgcgatggccggcgagagagaatatcctgtttcatcacaggaaagacagttttcattttgtttctgacccggagataaaaagtgttttagctgatatgtgtttctttgcgagcttcggactgaaatgtttttcagacggagctagaatttccctttacgctgactgctcgggaaaaatttatgggtttaatgataacgatcccgacggaaacttgactttcatcgcagagagttttcaggtttttaggtttgtcggtgtgcgtaacttctataaacatcacactttttacgcggctcagcccaaatggtgccagaaaccattgtgtcatttttcgtcgcgcttttatctgaaaactgccagacagggcgactgtgaccttctcttcttggctgcaagagcagatgagcgggcagcgtttcctgatgttggaacccagatttttcgttgctaagtttgtgactctttttttttattgccttgtttgctggtgggttttgaaattgacatggtaattaataaacagcgttcgtgctttagagtatgagtttgattgtatttgtctctgtgcatttcacttgttttttttctctgatcatttgcatgttgctagtatgtcagattctccgcttttggattccggtgtggaaacggctgttgagtcgaatgcatcgaacggtttgtttaatctggaatcgaatacagttgaatcacctgttccggaggtctactggaccacgtttttgcagagcttcgctgcggaaaccgtatctttcggagacgttgctcattttgttttgcaatatgctcaccatcgacttcctctcgtgtggccttccggcgctgagttgaggtttgcctcttcggagatgcttggcatttcggaagacgaagtctgcaagttaaccagaaattttgtctgttgtccttttgtggatgtttgggtcatcggtctggtgctctattctgatttatctgctttgatgcttattggagatcggggtgaattttatgcatttaaccgttccgtggacaacgccatttacagagttgcggacaccccttatggtctctggaagcgtggtctgcgcagatttgaccctgtgtacgcttttttcgagtccatcgtttcggggggttttttcttcggccctatgtgcggggtggaggatgttttgaatttcgctgttgctttcgacaaggctcttgtgcctcttccgtggcctaaaggcgtgctgttcgaattttccgtcccggaggaccatggagagcggtggaggttcattcctaggcgtggcgttgccgtggttatcggaaagtttgtcggaagatgcctcggtcgtggtcttcttcgaaagcaacgggttcttatggatcgcttgggtgctgtctacgctctggatgttcgcggaggagccgtcgttagcttggcttgtagttttagggtttttttggccatgggcgccaggagactctttaaaaactatcgctttcctgatagaaacgcttgggccatgcagttacccgtcacttgcatccacgttccggtagttcaattaccacgagaatatagtttatgtccatctgctctggaggcttaccgggatactgagctcagtccagacacccttagcgatctgtgttgttctcggggggcttcggaagagctgcggaattatgaaattcttttttaagcggggggtttttttgccttcagtcttacagtgctctttgtctttgctctcagattagcttcgattcggagaggccgtacttgtatgctattaaatgatttcagaaaataaaagtaaaaacacgtctgagtttccattgctgttccgcctcgtagttctacttgggagtgttttctagtgtccccttcgctgctgtgagtgaacatttgaagataagtataaacagtccaatagtaatgttatttttcatgccttgccaaaagcttgaaaacttagtgatgaccacaacaggattaaccacgcatatgctaagaaagaacatttttcttgcttgcgatcatcattggtaagatgcagactgcgcttggcaaacagtctgaaagccgctgccttcgctctgtgcgccgcgctgcggttttctactctacgggaagccgcgcctttatgggactaaagccaaaattgtgcactcagccttcatgctgcagctgcggtttggcagcgtctttctcgtgcacaaacttgtttttcactgagtgctgcgcgcggctcgcagaaaaagtgccttgaaggcattacaagacattggctgccagtgggggcggggttagggttagggttagggttagggttagggttagggttagggttagggttagggttagggttagggttagggttagggttagggttagggttagggtcagggtcagggttagggttagggctagggttcgggccgcagccctagggttagggttagggttagggttagggccgcagccctagagttagggttagggttagggccgcagccctagggttagggttagggccgcagccctagggttagggttagggttagggttcgggccgcagccctagggttagggttagggccgcagccctagggttagggttagggccgcagccctagggttagggttagggttagggttagggttcgggccgcagccctagggttagggttagggccgcagccctagggttagggttagggttagggctagggttagggccgcagccctagggttagggctaggattaggattagggttagggttagggctagggttagggccgcagcctagggttagggtcagggtcatggttagggttagggttagggttaaacttagagctacggttagggttaggcttagggttaggcctagggtcagagttagagctaaggttagagctagggttagggctagggttagggctaagggctaggattggggttacggttacggactaggattagagttgtagggttactgttacgattagggtgagacttagacttcggtttgggttgagttttgaatttacggctgcgtgtctcactgtgcccgacaggttatgcttagaggtgtagttcattgtaggtaacgtctacaacctcgcttgattgtaggactacatttgcttacgatcgtatctttcctgcagcttacagctgtgcgttgccgtaattaaagtcgtgtgtgacctcagtttaagcttgctgcggctcgatcccggaaaaaccttgtagcgacgtttggcagtgtttcaggggatttagcatgggatttgtggtcagggttacggcaggtttccaatggaaagtcaggtgtatcattgccttatttttagttttttttccaggtgataaggccgttttgtttataaagtgtggtctggttccacagcgtggttttcggtgttattgttctgcatctatcggagtttttagtatgccaccgctaactacggtggcacagacaacaatatggactgagacactttacctcgtcagccgcgtaaggaaaacacagaaagacgaaacggaccactgccacaactgtctgtatcctgtttaatttgccttcatttacagagaattttagtcactcgcgactttttgggacatgattattgttaaaaacatattcttagaaacttatgtactatacaggatcacgctagcctcatggctaacgctaaagagcattcatgcctagagggcacgtttagaaaacgaaagtaagtccaagtcacgtggttctctggcaggcaaatctcataatgtctcacgagaaagggcatgtctgcctcccgggcacactttgaaaacgaaaggaatcttaatcacgtgattgtgcttgagccagcaagaacagcaatgttttcagcgccaaacgctgacagtcatttacagcgtggccttcttgcctacactttcggtactccctctagtggcaacgaggaaggtgatttttttttcccagttttgcacacggacttatttttgggtacagtttgttctagagtatgtggattgttttttttttgacacgctgtttcgcgataacactcttgtactttttttcttttttttttaatctttttaattttgttctatctaggagattggtagtgtgcacacaaaggccaggcctctcccgctctatgccggccgggtgctgcgtatgtccagtgaccttttagcgcccgcgctccgtttttccagagtcctttcatagacgaggccaatctgcacattttggcgctctctggccagaatcctagaatggcacccctgccagtaactatcacccacacggtttcggcccctggcgttacgggtggcactgcgcgattcgtctcttttgcatcgtacgtgagcacggcacacaacagccacagcccaagtgggtggtccggatgtaggtgctgcagcagtttgcgtcgtgcgtttggccacaatcgatactgctgccgtgcgaccgtcagtgtgaagcgtgccgccccagcgacggtgtggggatcgtggtctgtataccacagttggcagctgacgccggtgtgagtctgacacagtccggccacggtgagtaggtcgtggacatcggctgcctgggtaattacgtcaaacaggtgaatggccgttgccgaacctactcgacggtctggcaaggaaacatcatcttcataaacctcggattctcgctgcagccctcgtcgcgcgaattcggtcacactgctggccaggcggcacagtcgcgccgttctcatgtgatgcacatacattgctccgtccctggctatgaggaggacgcgtaacgagttcaggtctgaaggcgcggctctgttgcgtacgtatccgacgggctgcaacttttctccgcgtccgcagcacacgtacatatgcgtgtcgagggctgccgggatgtagataacaacaaaaaacacaacagtcacacgtgaagaaagagtgcttaatacattaataaaaagttaatcgggtaagacaattgcgataacaatgtgtcacactgcttacactcaccgcagtcccgcaccgtgcgagctgtcacgtgtgttgcaggccatccccagcggtgactccaaacggtttgtgctctggcgtctcgatagggatcgtggtgaagttccaggctccagttaggcggccatggcaatgctacgagttctcctctgtgcctgaaggcatatccgtacacttttcgcggagaccctcgactcaaagacagccacgcgtaaatgttgaggaaggaccggtgggataaagcttcgctccatgttttagctctgggtttaggtctgcctctacgcccttggtgactgtcgctcgattggagtctcttgggactgggctctccttcgagtggaggggaagtgggagatgaggaatgtccccggcgtcttggctggagctgaacagcgcggagcatttctgcactcattggctttgtgttgttttctgttttttttttggttgtggttgtatttggtgtgtctctaaggtctacttaaaggaactgtctctacagtctctttcgttgttgtggacccacgagtactgcacattggctgtgaatggaaagaaaaagaagatagactattgccagttttggttgtaaccatttttaggtggtggtaagcgtgtaggggattatgagttagtgagatctctgtgtttacctcaccaagtttgtgtgtgtgtgtatgtgtgtaagatccacgggatccggttaacatgcaaggtatgatacaaggaagagttagaacggggataagaacgggaatagaggtgcactttttatagcggaacccgtattatttggttggtacatctgaagttcacatctgttcttttacgcgagaccttggcgagctttcagacaccgcgctgacgtcgcagctgctacgcctgaggctgggttttttttttctttgtgtctttcaggatagctgtcacggacaagagacgcgcttccagcaggtaactgggaaggcgcggtattcttattgttgtcgtggcattatgcgtcgagatcgctcgagttttgtgagactgggtggcggcggcgaggacggctgggctcctggcttctggcggcgtttctcggagactgaggggaaaggtcggaattgccgacgatacgcgggtgtgtttttttgaggtgttgagttttttattctcattttgctttttgcttgtgctttgtttcatctcttggtcttctgtctcatcctgttctccgcgcgtatctagacagttcctccacacaggttcttgctgtaaacatgaccaagacgtcaagtctgcggtcggccgcgacagtagtaaaagactaccggtgaccaggaatagcagcgcgtcgtccgccacgcgccacagaaagttttgtcggacatctatggcggtgaccagacatgttcgggtcaccgccaggtgaatgtgcggcatctttactaggtagccgatggacagccatgacccgcggccaccgcagactgcgtccattacatgtggcgttgttttaacggacgtgcgagtgttttggcagggtgcttcttggaatgagcggcccgtcagtatcatgtccaggacgtagccgttcacggggtggattagcgaacacggagttcctctgtggatttttagcagcgagtataacgcgtccagaccgtgcgtggcactcacggcgagtgtttgcgtgagggtggcggacgctggcgggctcgccacccacatgttgggcagaggaacgtgcttccatctgggtgccgcatataaaggttcgcagtggcgaaggcctagcctggcgaacaacgatacagagtgggccacgagatacaatcggccgcggtacacgtcgtggcaatagatgctgccgtccggtccttgaagcagcactaggatcggggaggttcctgtgagccagctgcagataacagtatggtagtcaccccggtcatgactgtgatgcacatcatcaccaataggatgaggctcgtcactggagaatgatctggtaagggtgatggagccgagcggaagcagcttgactttagcattggggaagtaaggacgggggtcgaaacctgcgatagagcaaagacgttatcggcaaagcgacaggaaaggacaatgatgggaggttttaatgtcattgcgcgagcttgtgcttgtctctatgtgagccctgggtttgtgaaagagatgtacggtagcttacatgtgttgtgtgccgctggccagccgcgatggagatggtgagcgacacggttgcggagattggagtagggggccgggtcaagttggagaaattcctgttcgggccacggcagcggcagtaactgttggcgatgagctgtgacgtagttgcataccaaactgagcttgtgtcgtcccagaagcagccaccagtaacgattgagtgccgcgcggagagcaaaatgttctgtggttgcagcagtcataggtggtgtaacacagagtctgtgatagaagagatggaagggtgagtggcaagggtgaggaggcagacggagggagggagctctggaaggcgggctagcagcagcgcggcgccgacagttcccgcgcgcgcaggggcggggcaaaacagatttggcggcgctcccagtaggtcacggaaaggcagggcgcacagccaagagagcgcggagtgcagaggcaatgtgggcgtggaagaggaagggttgagaaggcagggcatggagaacaggaggagggcgggacggagggtggggctcggagcggtaaggaaccaggagtcagggcagatatggataggatctagaacagatgacttggagctagtgttagggtgacagtgagagctagggttagggttggggttaggcttagagctagggttagggttagggctggggttaggcttagagctagggttagggttagggttagggttagctccccccctttttttaccccccgggggttatttaggatttgaaatacgaaacggggggg

SEQ ID NO: 60 - protein, 98 aa, herpes simplex virus 7
MGFVVRVTAGFQWKVRCIIALFLVFFPGDKAVLFIKCGLVPQRGFRCYCSASIGVFSMPPLTTVAQTTIWTETLYLVSRVRKTQKDETDHCHNCLYPV

SEQ ID NO: 61 - protein, 82 aa, herpes simplex virus 7
MSASRAHFENERNLNHVIVLEPARTAMFSAPNADSHLQRGLLAYTFGTPSSGNEEGDFFFPVLHTDLFLGTVCSRVCGLFFF

SEQ ID NO: 62 - protein, 82 aa, herpes simplex virus 7
MVQLHYIIFASLIKICTNTVPLEKARTAITLEDIIENLINENMHNASSTRYIGLSSEERQSLLEYTRCTSFSCECEWPDEAQ

SEQ ID NO: 63 - protein, 105 aa, herpes simplex virus 7
ISHTLLLILLRVILLETTLCIPLKENSLGVRGLREKIMSKGLSEVLSVTTGLHYSLLNGGFGSKQNSLLYVKRMNTANILTSLVLFPARHRWERREQYTQSSAQW

SEQ ID NO: 64 - protein, 90 aa, herpes simplex virus 7
MPVAIYCNLNIFSFSWEGIKAARINSNYGANEDPTPKLLEVEEFFDYIYEATCTTVEMRYPERKAQQVFASSKDSKKFFKSSVKRQNRDI

SEQ ID NO: 65 - protein, 91 aa, herpes simplex virus 7
FLCNKIYKFYYRYHPDTTVEETIRDILQDSLKCNPSFDNTLFQELDSFDFLDSISSNDIATANASYSTNVEEGASSDIKLAAGIFFSFSYI

SEQ ID NO: 66 - protein, 1082 aa, herpes simplex virus 7
MDQEKADIEDCLINHAGILTNDRHMLTDLALEQLSQMLNVNLISGASSGFISFYEDILSGEQLEFFLWCESRYTVYACDKFDEIVKKVIADCREYLSDLRNNMDREFIKCIKKIISMGNFISSNEKLNRCATMLLMMGKNRDITDINISNQAFYIKTNKIKKDLLECKFEIIEKNSRIAQTMKDFAIKQMNQMFMSMCDETFLKIHFNCINLIEAAKNLGAAVLQCIVICSKEFSCKKFRANRKEFKITLMHMINDACDQIEKLYDVTGEVTVLNSISIRNGYVTGNGHHSSTLLESHLYNSDSTPPEIEDFNDYGKYSEECSETSEQSYQSVHQNVSPTQCVSKSEQYNVQSNFSDICQTIKTTLAVSQASDESHSKNTTGKNPEVCTREYKLDFFEEIDTQNLAKKVVSKDSPDCLMYPAETNPGMSTEESEVNVSEGTDTQDFSRNTICRFLSDNPIISVEKNSEVNAIKNETGLSEAAATQDFFKEATMKSCRDTKADQILTGQRKTIKNKQKVSKNNETFNMSLYNLKRNEETYQDKNSLNFSNEFPHTTFSRRDKKTDNQAGILMERSVTEEICVNNSLTFSNEFPSTFSRTDKKTNSPAGILMERSIFNKDTQDKEQYFELFTMTNHALDNQNKGHNLSEDKTDVKIKTDKSLSGQEEMIKNKQSVSQGNKTSNVNFHNLNRNENKYKDGKDLIIPDKFPNETFYIRDKKKDISTNRAVERSTADVDTESDVEKVAAEGLILLEQNSNNNSRDTDNTNLVISEMETYGYDTDKSTIYESESSSTDTNSTFSSVSLTSFSDSQTTAHDFSAVKKKQLKRKSESKLKTSKAKKKKLIVKEGCNNMELNSCTDTDNENMSNFNTEMSTDSIPYRSKLINNSDNCENNGFPSVVFTIPIRSIRGVTRGVRVKIVPKKNCLWFLRKTHKVNIPDTGMKKDENKELTKQASYCFNNHFIPIRSNDEEYRRENVSYIFPKLQENFIEVDSISETKTMVTNIIMDNFMEITEMIKNGINRHYEELKKRYANKNVSEMNSFILEQSVDTQNYGKENTDSDQTYVDFLEGYPQGYDPFLENAQIY

SEQ ID NO: 67 - protein, 1205 aa, herpes simplex virus 7
MSTTADVVREAMTLSGLYNEIHDHTKPENEITYSNFNNQEIVTSKTLQDPRRAIPLKSRSTFTSESSPNTTETGQFRFASELPHQGLQSLYYNYPQASGENFISLPYQPQSSVDIFNNLDYKNRELCHNSFDTTYRQHHYRGRNNRGKYDSRNYCNPNSKYQNHYGKHFHRPYNRRGRGYAKFHDFSNRNEFTFPEYMQRDQSYDSYNSDFRHNPYRDNYQQLCPNYGFQSRDYSMAFSQIPSSSMITDSQNLQKECISSGLTLSKKSEYSQNTPIQTNHKETKLISNVNNLEKPARKKTDKDKTPQNEDVVSLSYIPSSHKMDLIKRIYNADIVPLAKDSLSSTSDVDKCKYNKSSQEKTFMKARTRPSTSKEKQITSTTDSKHCPNLDKGSSNLKKKDKSPDEAIENLRKLSKLEPMLSPLPLTPKPDVQESNQRAPTKLINFKRLLEKNDKDISASDIEFIKQSSRCTVSTALNCNSSTVFSDTKCTGKNSYRVGRPRQAKTTVNSKIDAKENDFEGKVTAPCNIPSIDNPPVESEKSNTTDSMCNDNLTQRTRSDSSSTEEGQYKSPVNDYSQSEVEHVHSIENQHMEQIISQTTDEIAQNFVSPEQEFLAKSDTENGLFEFFDNELQCTQNSSETKKFPISDRSMSPKSTRSSSSDSDTDTSSSSSSSSSKCSCKSSSSASSKNSVLSRNSCSSTELKPSYTESPNSNGNRQCDFVSKVDMSEFEFRCGKELNLYKHVESRLQLDQNNEHLYNPRFRPHIRKKRPPSTESESDTNSDLQSQSFSSSKKRRHEHRNTESESCSESTKTRHRQKHRSRSSSDTSRSRSASKSRTCKVCSNNKQDSQSETQCKHLISISRSNSEHSISESTYQSCKNKNSETLRSRSRSSESDCKKRSERSCSNHSWSSGSTQKSKRVDIDFTHGAKSIPNEYEQKKSTNKFFKNKRRNARKRFSDDSDSSMQLFYKKRISGTQKSDSELSDNDLSYREYVKLQEQKQSAKFKVQRGRVPTKDFEKLFRKTIRAFEYKQIPKKPFPEAKLKESVYALCCNGSSKSGALIIYFTRSKTVAEDIKAMQKELMVRPNITMSEPFKMNHAPPRYYDKDSIKNFIELQKKGPHELWENISNSAHTLYTRHSDLKTIIIYAATPIDFFMAAKICNNYAKKRPKEIVLRLSSITDGDNPISIYNPVSRDFLSKYTALCKF

SEQ ID NO: 68 - protein, 280 aa, herpes simplex virus 7
MPFLGAIFIKMIGFSVIIYALYPIMHHRVELGNTIVFQCTVDTTKNLSSVIWFKHYELILNHTINTKNLKNMSEKIVHEFKHRDKESIIYFNANNITALLKFKSRTINDAGCLTCAFFAKTRLSTMSCVHLSMKPIIALYYRHLQNFLDVTCSVTSYPKPLVAILFLDKIYRQDSPTVRENYNGSQTTTLSFLFKRQGSNTFFGKPITCLSYGGEIDENVTSIIQPFENPYNDTILSDDSLKQSELINNDLAWIILIISSVLLFVIIASTLLCKLGTHQH

SEQ ID NO: 69 - protein, 310 aa, herpes simplex virus 7
MRGKKRKTVCKAKGKLTSKSCMCTKANARYTCNCFSKTLPFNEKAIKCTIPEKINSEINISKSEMLLKADKYTNAIYKHSKLRKIFKAVKENLSTTNFATKSKGIVHSNFNDSKPIHSPEIKNYTDFNCDFMHPCGLCSPKNFLSEVYKLLRFYNSTVVQIQVYSRNGLLVNSLHEKLMEIANLIVNKGEQTVSETFFHEQKTAIAINRFLRGTVPHTELTRKEAMMPVNVNSKHRKNSGVYSLYINAPTEKDLFCAAHLCVQFSIRYPADILLNVSKLTQPLLLKEHLIIYNTFNRYIYWDDYGKLLKT

SEQ ID NO: 70 - protein, 246 aa, herpes simplex virus 7
MKTNIFFIFLISILNQIYALFNNSYYSNLEQECIKNILNCTQSKTLSLLEPIDQAPIPKSDIISRLLYHTPYISRRDQVLIDEDFLETFYLLYNNPNQLHTLLSLIKDSESGHNWLGFLNNFERCLSDNTLLTCRDNVCKSYSYEKLKFTGNIFVENIIGFEFNIPSNMINFNMSILIYLENEETRTQRIVRIDHHGINVFDALLNCLRYFSRYYNFSFPLIQEMEKYNEVLPFRSEFSNLLIRTY

SEQ ID NO: 71 - protein, 254 aa, herpes simplex virus 7
MALLQWMLENISDDNSIKMSLEEQHETFQINVKWLKFLNLSDSDIVQLQNVYKLVQRDRERLIIYPDPQNVHSWSYLCSPEEIKVIIVGQDPYPDGRGHGLAFSTVRGCSPPNSLKTIFAELERTIENFKAPAHGSLKSWCAQGVLLLNTVFTVIRGVPMSHEAIGWQVLSNRIINQLSEKMQNLVFMLWGSQARKLVSLIDSKKHLILECAHPSPRTKGSKTPFIGCGHFLKANKYLQIHNKCPIDWNITNDL

SEQ ID NO: 72 - protein, 640 aa, herpes simplex virus 7
MLRNQSVGNGVSKQASAKAATFSTINSTLAADDMFKRNFVSYLPLNNEDNDILFPSIKTIKFIEMLHGKKEFFKGQSIHSVLRDSAVFKKQMFYTLSHTLLNSISIQQINAEWQRHLKAFPFRSKGMSFQEYFNIWYYAIKQVILEGILQTINYILQNLDNDIYNKYIDWICTIGITPIVTLPKNKVTLTPLAKSISSRLIQEIIRNKQNFLLHILTQISSTSIADFTNINIYRNKSDGNITCLSNNKELEYFVYSAPYFINNQLLFTTPLAHLYSELNKHENLHRHRKMCQLLNTFPIKVLTTSKNSVDNKKILELIEREEKTSDAKKSLIKFLLNLSDSKSKIGITDSIEGFLQDITPSIIDQNKLLISKGNLQRRGQDNNDRDIRDIFKKQIIKCMEEQIQSQLDEIETLKTANRLFENKIKDMHSLINLSETSKHDFTLDSDIESLSLAKALNKVQSLPFTSVSIDDTRAVANSFFSQYIPDIEYADKKIDQLWETEYTRTFRLRKNVNNQGQEDSISYSNYTLELLLIPFMKHVLKLRHFELLPEEFLFLSLKEIMLAVYSNCKIKHYLRLIYIRQINELSHLIHTQKQSDLTLTPDLGSTNPEDFQYPQDDVASKLKRIRNSRHIQYIKRPEYL

SEQ ID NO: 73 - protein, 346 aa, herpes simplex virus 7
MALSRVDVINMRIWVLSIICACLTYVNVTVHLVAVHFPNLGFPCAYYEINDMKAINLSIRNDIRSLTPQLYLNPIQLICYVVFMDICFFFILVYYIVCCVKVFSSEKTPNINQSTRDITWMGDSLSCFQFVLTMDTYQFFVTCLSFRLVTLAAFTYCLFFICFTAFTLTMITQYQSSERSFFVLKRIHPKLKGTIKYKTIIINMIELMLGFSSMVFAITICLGLGNNFYIKSSTVAFASINTFFVMSFVYSLVIELILHQYVKVQFGLHFGILFGILGLTYPILKYDSLFKTEWTVKFIVNLAVITIVCLSFIICRLIRFFMRKHHNYKKLPTTVEDLDVLEEANE

SEQ ID NO: 74 - protein, 1345 aa, herpes simplex virus 7
MENWRTAEIFPKLDVSPNVFDDIRTQTAEQLFENLRLYYGDDSDRYNISFEALLGIYCNRTEWIDFFHTSIAVAANVIRFNDLDKMSLGKILFYIQLPRVATGNDVTAPKETTVLVTKYSEKHPINISFELSAACLAHLENTFKNTILDQMLNINAIHTVLRSLKNSADSLQRGLIYAFIKTILKKAPPQFILKTMLENKVNSKQILSKVQRSNMFQNFKNKLINSLFFLNRTSNVSFIYRYLCEMVDSTTESILNNTNSYVLKDGTPINGVLLGTPNTIQILSNALSQHISQMTMSVPVSYGTFVMGKENAVTAIAYQAIMADFSNYTKNVATETQDQNKKSEIFENQTQHADLKTNIIQLSDKTVVLDHLKKVYKNTNIEDPLEQKLELTFFFPMGLYISKDSGFSTMDSRLKLNDTMENNLPTSIYFYNKDKLLQRIDYSDLLPSLCHPIIFDCSVSERIFKNAAKPTGESFNQLCQVEFVREPPSTFLSNLYNLYEMKKEIPKTTNMLKNELTTEDFYKSENFTLKTELHPFFDFTYIQKNRSTDVLCSPRILLGNIPLPLAPSSFHEARTNQMIEQAKTNNLNYDYTLKLVVESLTNTAYPELAYIIELLIHGNKTAFQILKDVVSQCITYWYNIKHILLFCNNFEMIWLITTYLGDESIPGIAYTHYKNIISILKLVKRTISISNFNEQLCGEPLVGFVNALFDNRLFPPFLNSLPKNEANAIITAGNTPLTQNTVKLRNYEVSDLNRMNLLDSTEIFTDVDRPSFETIVLSKIFYFCFLPALTNNKMCGAGFDVKSFILDFFYTEPFILPDDNFCELPITNNVLIELITEAVGPSHALTDLSCIGKQLFKSILYLTENTKILEIESSLDPSQRHGSSSNFKSLQHVLYNGLCLVSPINVLKRYFKPIPFNRFFSDPIICGLMNIEVQTYLNIFPHYQRNDGGFPLPQALSHEFHNWQRTPFFVYASCCSNSLLSIMTLATMHCKLSPIAIILQSRQKIHPGFAATLVRTDCFDINCLLYSSKSATSIMIDDPTVSTEVKDISTTYNLTQHISFLDMGLGFSSSTAIANLKRVKTDMGSKVQDLFSVFPMHAYTNPTVNSWVRHHVGIEKPNPSETDALNILSFGKINKQSQSILLHGQQAICEVVITPVTSDINFYKTPKNPRGRASCMMGVDPHNESEARKSLYDHSRVDSDAFVATTNPWASQEGSLSDVLYNINHRDQLGYNPKSYSPNAVFFTDTEIFKTNKFMFKLISDYSIKTKTCLDSDTDIQYSCSEGTDDVTHRPCQFLQIAFPIHCSSNQALLESRSKNGMTQLSETHFANFAIGECIPLQNIIESLL

SEQ ID NO: 75 - protein, 293 aa, herpes simplex virus 7
MDSIYCTFDQKLTLSDIGTLCKLTNAVIPIPSHRHLIGNTNLGLYTVLSTTTDYIQIRDILKTMVLTILQKVEGNQLILIRPKIGHQYEIKNTGPFPLEKGDQLSLLPPFLKPSQQLLVLPNWELILPLLIPTDVATEINVRMLCISLLSIHRKYEEVQIIIDELRTLQYRDVTIKLPDVINDCKSTFSMKTACISFSMIATMAPDIVQTYIERLSLEDQSMLLIKCQELLAKKNFSQEPSSFKATEIKTELQKIKTVFTMINQINSLTQEKTFFIVADVSADNRLATCIFKE

SEQ ID NO: 76 - protein, 430 aa, herpes simplex virus 7
MSLATSDILKYVQIEIPYKEEFQGKDNVTLLFDEYVQSKTEPVLLLSAEINSRNSDSFFSARPLMEEQQLKLHLKNLNRHIYPSKVLFFGFPLLKINSSIVIIPNHDVKEQEQMGVFPSLIRFKNEKVIVTQTPHKVNEITVTMFNIEWKLSTYQRSIERTPGHPLTTLCTVCSVNINNLPFWFHDVRSGSDFPTCKVFSISDPTVSVLKMIFSPPLLEIYLRCYTEVTKNNTYMVPNDCMLKLGFVNEIIPNEISLTVHMHYFKICSDKRKIDVFFQDTMLFDEGETKKLHFKGTFYNFNANALYVPDPNSKVQSIASFWSPTTSFTTKVTSDRSQRVTTNDIIGSIYFIPTHILRTKFDPNYTDSFAAEIELNSEDPESDALYFLADKIFISDLPDLILRKGWSARKKKLQSGSNINNHAPSKSRLRF

SEQ ID NO: 77 - protein, 427 aa, herpes simplex virus 7
MNSTPVSELSQLIQFTVDFNDLQPELNFSPAEITCILSHERPVLLLITDGTENNAECVTLVGHVLKNKKVIKINVFPMIQSINFVNIFALPIFNITSSLLIQDNCYFKENMDPLRFHQFAYLEKGLGTTPIILYSVKNGDLIVNATVTKITWEKNEFQPLLKNSNDQKLETMYCIFTFNTTYCKYWNVFFASATPICNVEMISEHNLSVYKIEYRSPVLFVFLRYLKVMNSRFCVDECSLRLRLSKPNMQSVALNICMPYFNISEEFKTMEIYFPERMTLTPNHITQINLRGTFENPAAVGLFIPKKSNVLSFPFIWQPRETFRIYVYCRNETFVTEHDIIGHVYFISREQFPHSFHPTAHADCKSKVEAAFNSFRINFLGNDFFSDSLPILTVHPMTDFPYEQIQETENIRHNSMNITPRFKRMQL

SEQ ID NO: 78 - protein, 455 aa, herpes simplex virus 7
MESCYVVWSSYFLQLKLTAPILLKPREIRCLRTGLSILSQQSTFVCMCRDEGSFTAAYFTYIDLRDCGNVTLAVQNISDVDLDLKQFPLIINLFAFFLPSINLVSLPVQIVERMEHNYIPHGECRAQFILYGSQTKLRAHIKRIRWTELQHEEPTHYMYACEFWIDLQTTPPDQIFNSAKVEFISSRNVYFKQIMLHEKILVIRASYENNYLLNPDNFPSDIFFQVNFIQTIPHIVMERNQEPVMTYDGTCITVGSTKNINSNTTDPFSCTFPTFFDSKQKFAGLFIPRLINGISLNTFTWKERTHLQVTMRAYKKNCRIDYSQELGKLIFLPSQIVTHDQSNIDFGWTETSRILISNQNNQISVFRSETTPVADSPVLSTVPNITAATNVSINLNSLHLNIAKEHLVPVRYRMRTDNLRTFLPITALPHTLTVLEGNIGLQTVPCPSGNRDINA

SEQ ID NO: 79 - protein, 254 aa, herpes simplex virus 7
MTQVGQYIISNNSTSNLILHITKKLVSGESLFNLKQEEILIIQNVCTLMFSHGIQILLLRETLHNIGVSDLVVLNRKVPDEFWFKIFCMIKQRSGSEILKHIFSEENAAQLSKKLHHTGIVKQIIESFFLDEFGLSITIPAEIIHDGNIMFSIGAIYNHRLLKLCRYFNKFWGQEVYEPFIRKICKHLWFGYLIFFDKIKISHGAFSQQKPEHRNGLFTFIQNDFKVFCGIVEKEAKVTECNLSDLFSIGPLQF

SEQ ID NO: 80 - protein, 690 aa, herpes simplex virus 7
MYFYINSLLLIVSINGWKHWNILNSSICVNEKTNQTIIQPGLITFNFHDYNETRVYQIPKCLFGYTFVSNLFDSVNFDESFDQYKHRITRFFNPSTEKAVKIYAQKFQTNIKPVSHTKTITVSFLPLFYEKDVYFANVSEIRKLYYNQYICTLSNGLTDYLFPITERCVMRHYNYLNTVFMLALTPSFFIISVETGMDDVVFIFGNVSRIFFKAPFRKSSFIYRQTVSDDLLLITKKTTIERFYPFLKIDFLDDIWKQNYDISFLIAKFNKLATVYIMEGFCGKPVNKDTFHLMFLFGLTHFLYSTRGDGLLPLLEILNTHQSIITMGRFLEKCFKMTKSHLLYPEMEKLQNFQLVDYSYITSDLTIPISAKLAFLSLADGRIVTVPQNKWKEIENNIETLYEKHKLFTNLTQPERANLFLLSEIGNSLVFQEKIKRKIHVLLASLCNPLEMYFWTHMLDNVMDIETMFSPCATATRKDLTQRVVNNILSYKNLDAYTNKVMNTLSVYRKKRLDMFKSISCVSNEQAAFLTLPNITYTISSKYILAGTSFSVTSTVISTTIIITVVPLNSTCTPTNYKYSVKNIKPIYNISSHDCVFCESLVVEYDDIDGIIQFVYIMDDKQLLKLIDPDTNFIDVNPRTHYLLFLRNGSVFEITALDLKSSQVSIMLVLLYLIIIIIVLFGIYHVFRLF

SEQ ID NO: 81 - protein, 313 aa, herpes simplex virus 7
MKNKMYSMLVFTLISFLFYSYLIIWTPVLSVCSEKISFVNLTNFSMWPKFAKFHYESFEKTYIQSCDIPISKNCFKQILFWSFRLSQKKNICLSKINMLYLDNFPRWTLHFEFPTKTNRKRHVYLDNISFLYLVFATLAFKTMDDSCVNKIPFEVLASHLFKINFSQNKIETIFQDLQNHTEAQLFSRENSEQLFSFTNFIYYFVYNRTDCKNSISKFFYNSVNTRNVSTPFGVTNFSLVRGIMSPIQSFKGNLMFLENKTKVTKPTAIPNAVTSEPTKFFPSTRGTSSMQASQQTSSFPTTFFTTNHSNTST

SEQ ID NO: 82 - protein, 379 aa, herpes simplex virus 7
MQSLPSRRSETNKKIISEKISETITLNKLPMSRYLHFFLFTVTDVDDIWNFSETKESSLTWPKIDAKQLNEYVNTELTVYQRPFSLLGIPQNGLFKSCEKIYDEFFAEHMDNEKKYLTFPRNRSSRFGFENVPRVNELPILINHFEKSRMDVILNTNKIVLVNRELIWVPCEQVRIFNLNVSLNIPDGLFGILTGTVNDTLCECVTELITTENVISISLINLSSESVMLLPGDIELVINILPCYIPEPWETYNFPSPNFIKFSLITNKDFYVESNNYTIQNFDYMFDCPDELKALIIANKEILCHGLVVETNIWLKNTTPSVKIFNPTSQRIFVQAGICIATIIFTCGHFILKLLPNRVLNQLAVLDKTSMLWFQYSTE

SEQ ID NO: 83 - protein, 861 aa, herpes simplex virus 7
MTITVFATEYDPAHVIVNILCKNPSEHLIFPIIVKYKPSKNVYFCMQTQKCKFSKRIETVFVCDAESLNFSYYVKNALPIKSEDIIHCLNTEETENLYKDFLLSHVPEGSENIEFKSLVFFCKTIIIKHLTNKYLLPTSPFWFLSTYGQTEGMLLLTMYYYLFEEQKSTIATTKNYVQCFTDKLGDMVFTYSSMSEFINITLKSNYRKKFVSFSEYAKQKNIRDRKEFLYLDKQIDIFRNSVHLTNSFRVHYIYIAYSTALEKNKFIKYSQLTSYDPTRSDTSQCQENMYILGNSLHSDLISIMKQYFNEDSYFQNYVEIKRMLNNKFQMQQYVYDINSNRNIMLVINSDQISKMVNKCNKHGEGYFTPIKLGLQGFLKILASNKSILIDGKPVTRRQYLHDQFSNPIPMFRVQMSYKNLYCFGSAESWYKNMGFDQVMQFLPNEYISDESLTSTFWLQDTTFLSDEIEKQFYVTRHEIFNEYLPVTNYIGDLDLPLQDSAIITESLFFSMCKLMRNVLINAWQKIFPFIDKDAYPIFFFKTTCSNPENPLNHNVCYNEVETAFCVCKKKIGLRIAIPIPQGTAIIGSEPLKQLSKIFNHLMCLNHDLMQILNSVIFPGECFDTGIYNTGRCLRLGFMYKVDEENNRFLYGRLKPIFIVPEKMKKNFQDFVSMQLDLNNILHHGTKDQTITEIIYSIFDKACPTEFSFIDSRTKQLYHRKQSSLETLCLKYLHVNGFSETSCLSRDDLLMTFTRSIAWPQMLKKNIQHCEARTATQFQHVTFLKIDHKNIQLKKLQNGKLSDFSCLTRNHKGNRENVLVYLEFKVDNNRILIILWSKCFTTKCKSNSKQVHSSVVLDSLNM

SEQ ID NO: 84 - protein, 526 aa, herpes simplex virus 7
MNKVLIFDRNMYPRGVKKNVLGRQRYGLKTIKRTLVHKPANKYVSRFTKQFHRRIIPIKQLDESKLDALSLRELEQLKLIIEEKQEEKRAQTHALTFFANLPTAPFGSSYTAEALGLRKYSGEARDPAHRIRDRFPRNHEKIYLEKEELMTTDLLLRYKNCLNSLNREQHQQILGDRVFSLTNSPSLAFSLAIIEEACIYYKYHFVHNLPIDPQDLFMYTITIMKFEYFNKLNMAKLCCVFNDNGHGDIEYRIFRQLCGKPVYDRDMPNTEYEVQQQTPGSFQYPAQQALSFIVTFARILRQIKERILQTKQPQFIRDFDQDRVSEQYQCGMISRLVGDQFNNHQCDDIGCQTRIQRMMSPWKPSLYFCTYLPKEFVEFGLHPNMPEEYNSFNVACSTTPSCSFASQQSKQTVQLNLQTKKQAKCKKLLTADKTNKGQKTNELRENRLKKDWSKEVDSIDFETNTTLQEDETRFVFIENDTSMKSAKIKENNGEENSDNEMELDLDYEDVETCETDINDTDSDDSD

SEQ ID NO: 85 - protein, 1131 aa, herpes simplex virus 7
MADDNETVVSAPICTAAWLYILPKEQKLIEILTTLSLMEKRKSVVISPLLLNLTVENDFFPTVKTPIINYGGTVITKITSFMPVCFFFHGTDVFLKEAEDHGNLDKLCKQTREKFNLQEFVVNGNRKSVDIGKICESVGRNADDVLCHIVVGNGFKELLFAGLLIPCVEEQIQVQVGECLAIKIPLYSATLFESEETLCIDTCTEFIQENGFYAPQISEVLFYLIFTSWGMTLRFNNTLELIKAGLKQFIQDTEQTVKLAPNKTYHGIPGQKLSPIEKDHLMLVDAVITELTFSYTAEYLDSIYENNQIMNFSEWPIIKSAETHEEKIVELKKLRLHLSSHVAALVFAANSILYSNKLAYISNTKQAFNSAITQETLLRSIQFCNSLSSLNEDFYNDARKLIKCNSSPCKEDKFSAFHLAYACATCPQILSHIIWNLNRMSIYNTNCGNSEIYNHIVNCSSNLCEFCEGKCCHSCIGTALIRINSRLPQISKTTKKEPIVMTMFSRFYADVDVLGSFGKKGVNESKDPMKEAQTTPSLDRFKFLGMIHDYCKKNNLIDAITGEDNLNFKSQNDFVNMINDLIQCIEEAVSKCISEMRKTQTSREQIENCLQSFNIDTTPLSLAFSPFFVFTYYKVILIVLQNLALIIGTGYVVDRPCTGNLISKWLMQQYQSLYGAFYNSHFKKGFLNMKTVKIASNVDMEQYIDFNLFKSGKYAKTSIQAKLCRLSMQCLKDFRVKNRPFNKPNKNTQNNPFFKKVKQKKNPLSGCLSFLLFKYHERLFPNLKISCLEFWQRILLNNMPKTIDIGNVEDMRSFIKFTFRVTNSYDEIDLLDIQPECLLSFIEYYFHNKLLSVLGYRDYLTSLHALTSKLVPQNPMLFPVFLKEHPTFSSVQEYVMHVKKLVGNGLKEPMTASLTKEPNFGSIFTGRSIITFGLMIEKFVSVASRDYFHFGQLGWIAGSGVDRNLNPPSSGLQDFRFMRQKFVIATKLCDIIVKKVKREAIVYDVEVIRGKVLNIIESLSNSVNPELLILAEVMKDRDSKPTMDDMLFYVDGREPLAKSVMNKIQHLTDLNVHDFSLSTLLSVFEEQVEDSAAIYDFSELLVEGNEQGFGILKCEETEHENEEPSLKKARL

SEQ ID NO: 86 - protein, 721 aa, herpes simplex virus 7
MNSLQSLCVLCSRLSECALELECLRFCDPVTLIPDMTNFRKNGVVIIHLFKTLFAELCHQNFNCASPVTIYLQILLKAMYNQVLLLDASIHQFLLDNDKQKYFENIFQLNECKQHLKLDLALNNYLTFSVDISTINDIEKLLCKMNCIFGLISPLDGINACSQIIEFLTILCGVCVVMKPEVFSETTTCLKCYEELSLVPNQGKSIRKRLAGKFCNHLTETHMVSNLEKNVDIIEKDLDFSTKQYGLVKEYMAKITNIFQQQLYSKPPHLQEAENTLINFDLFSKIPDTIYSLSEFTYWSKISESVIQKASITLNQLNLCHSLYADLQNEISKFLYGETIQDVFNFNEENVTNDDKLYIGSRFISPCRLVDIITNVSIKNLEEDPVFTKLAEEDEIQTKIKTLLNELENSAHETVPKKYVTHSMTQDHNLQQEIHIRKKAYYQKISESGYSKVMLCIKEQEALINKLMNINILGNHIFESLSKMMNAFANRQLQSLENFSADPFTYDDHLYIKNNLLSKKLPQELLPNLSQEMYRLLTGPLSNYHTASFPLSSNISMAYACDVADFLPHMKEDLAKCVEGTIYPENWMLCTYNKFFNFDGLHNINDMQRQMWNFIRELVLSVALYNDVFGKQLSIVKFGEETETVEKILLTFDSGSPLLFKRGTTTTKFNDLYSLLYFDLKTQCDPVQISQTKQVSHIPAPNLLDLCRQNENSIPECFYNF

SEQ ID NO: 87 - protein, 1012 aa, herpes simplex virus 7
MDLVSFFNPYLENVRTKKKTKSTFLRIFPRGIMHDGAPGLMKTLCDSEPRMFYQDKQYILKNDMTWPSLSQVAEKELRAPLKFHIYDASESLLFTDSIENIPFQYRHFVIPSGNVIKLFGKTECGKKVCINVFGQNSYFYCEYQCKKELNSRICSLLNSSEIKMSCSFSIESVTKYNFYGYNTEPIKNLFKLSFSNFYISNRIGKILLNEGVSVYEAEVEILNRFFIDNNLKSFGWYQINYLSIQEFAKSSNVEIELNCHVSDLFLLKEDSWPLYDCCSFDIECLSQNGNFPDAEQMVTSSLISVIDFDSEGNYQSKHLFTLGTCEQIEGVFIYEFASEFELLYAFFLFLKCKSPEILTGYNIINFDLKYLCTRMEKIYNFEIGGFSKLKRGKFSVIVPYEQHKKFLNSLTKVNMSGILCFDMYNVYSSKISAQNYKLDTIAKLCLNQEKENLSYKEIPKKFIDGSKGRAVVGRYCIQDSLLVVQLFTKINYHYEMAEVASLAYITIRCAVFEGQQKKIFPCILHEAKNLNMILPSMNTNFNKGKENVGYKGATVLEPKIGYYATPTVVFDFQSLYPSIMMAHNLCYSTLVVDENAVIGLHADDILTVHVGPVTHRFVKKTVRESILASLLKKWLDKRKEVKMQMKMCNNPVMEMLLDKKQLALKTTCNSVYGVTGATHSLLPCVAIAASVTCLGREMLCKTVDYVDSAMYSDTFFIEKFGLTRGDFSGTFGIEVIYGDTDSLFVTFKNVCPKALKRIAPSIASHITNTLFKHPIKLEFEKILFPLILICKKRYIGKLDDATLVFKGVELVRKTSCDFVKVVVKDIIDLLFWDVDVQKSAEKLSNMTIQEIYENGVPDGIQKIIKKLCDARDALFLNRVNIKSLVLSSVLSKDISAYKQANLPHLAVVKRLAQRKEELPNIGDRVMYILIAPTETVKKTFHNYELAEDPAYAIENNLKINADKYFEQIMKAVTNAISPIFPKTGIKKEKFLLSILPLKVYVDQSFCDLTDVL

SEQ ID NO: 88 - protein, 104 aa, herpes simplex virus 7
MSNDNAKTDIEILYEQLSSRVEIEIAFLPMLPKLYDIMLPSLDARLHFINVGYRHLTYLKYLHHRANQCSHSEIIKKKIKLLTSILSKLLNVNGILEHQEYLNT

SEQ ID NO: 89 - protein, 258 aa, herpes simplex virus 7
MLKEKMYDELILSTCRVLKLGPADFRVTDKNLFSKNPKFPLCDILLKLDFAYSLEYLLSLWEDLTKQEARFIFKNTGGAVSMSCYLHAPIKQESQNIVKECNILNVNECLSVCLNDIEAIKPSSSGVLTKCIIRRNRDAAFIVEFVAFGPESESEYIALLKAIILKKKFLERQDLEKHRAARHIKKPLRLQLKSVGEMTSFRSINYMGNTKDAAVFPVTVPIFARRNNILCGFLVAALLIVCYVIFKEFALSADFSAV

SEQ ID NO: 90 - protein, 90 aa, herpes simplex virus 7
MAATRGDEITAQINQISGNSSKKEEEKKKQQMFTNILGLHSSMGSHPVTGTFLAKYAKQNTGNIEKAAFRLDFLRMLALHRLNSKVSESS

SEQ ID NO: 91 - protein, 286 aa, herpes simplex virus 7
MEMLQKRKHQTIDETSLNNLIENEKKKIKSLLAFGVPKECVLSRSFTPCELLGPERDHLGMLMFRLETDAESPKFLLISVLFLAMNAFNVSFCTRTSLANLYKTSLVDSINTMLDSCSYLEEKVSLFGVTNYISQGTNCLISCVMQGHVYDVRKENIYGLVILKDLLLEPDWEPRQNAIQYIYLCYIYRQAFNKIEYGIYIVLSELTHEEVLIDLLRNKFSKERFMFMNYLINGDGNLNYFGSLQRIGHCKTQNIKSGILDLQGISLTIIRLKDVFVELCERKIFL

SEQ ID NO: 92 - protein, 806 aa, herpes simplex virus 7
MDPNNKVSINKNMGLLRKCLCHDEYNKKRFCYSRFHHKTLLYKQLYEISKILRRLNSGLDMWCLRDAIISALGAMHDAPHVDRLLGQFYLKTNSASEFDSISLILESENILQKELIEFVRDSKVELEKILQAAIHVWRAKFSPGVLAASRFLDEISNSFNGIEENIPTIFLRISVTLASQIKKIEYLQKSFVSHKCPLVEEILILLYKRVCMLPFPCMSNLGLVSEKKSVFDTVFHNVSNFSLEDFLDINSGFFLPAMLNGSYVSVNLTRYHYEAESLMELLLSQLQIVEKDTNKTTGLTIYLEIWHLSLLMWLDFCEILPTTVQVKFCLILPEIFMERLKTENSYWSVFHKALAINLGLYDESDFTSKYLECERTAEHARIKTETLLDNICRCLRRGQMGFIFRKNIHKYSMLPQIASYCLGNSMDVIPFEYGLNTAFRIALNLSYFVENVSEEQKSHTNIDMFHYRDKIFNLKKMRKTVTELVLIGNAVIDYALENRDFLMDGIVNARSLAICVTGLHSALMSMNLPFNSQLGCQLYRIVCENIYYSSVRTSMNCCKKGAEPCSFFQRSKYAQGILHCDLYDNVEYTLPNVLWTNLRSDIKKYGLRNLTFVSGSAMSKEFDLLNCSQSFCPIEGNKILKRSSIKVLHPNPVFHSDLSVYSTELQTLYIPVYNGLFLNRFKNHLEYLSSVNYDVSKVNKNLFSEEEMQEMTIFLNAFDYSVNEMLNMYVGALPFTDHGQANVFFINKTENMRDILVCLYQNGFKTGIYQAVYKNQKCDGVNPSKKFDLLSGFSDGVVMSTMHVFQ

SEQ ID NO: 93 - protein, 364 aa, herpes simplex virus 7
MDRSNREHHSHRDHREHRDSKEPPTMAFHMKTWKTINKPLRAFAKLLRENTTVTFTPQPAIIIQSAKNHLVLKLIIHAECLYITDTDHFSTKTINNFVPLFDSFMGIISNPDVTKLYIQHDSDLYTRFLVTASDICAQASIPCVNGQEIVRESGKSALRIDLDHSTVTEILKWLAPVTKNKRSNKNEMTLAQIVVQVNPPSIKFLTDLNEIEFAHSGKVVFHDAKCMRLVLSSKNLQQAFSTCAVLKSSCSLRAIAGKEYKLFLIAKNVFLTVEAYLSQEQVKDDPKFERQAKTEEKGEKNHKVEEGNNFFCKQETQHKITSYMVPTKNGGTGTNFFNEKEDSESDDSAHFDYTPNSKRQRCGM

SEQ ID NO: 94 - protein, 320 aa, herpes simplex virus 7
MDFLANLCCVNKLTLLEEFILSKEGTSFVLPFPEEWRVTFHSLETIPEISKEDIEEIRNTYLCCEKTLIVVGVLHHVKKSTCRGPILLQGDRGHLYVYNGFFDKSLYYVSSNLQDFFLVGLKFFYPIYELCDFIVDFETGSKIVEHSKSFSDMIIYRDENINVCFILKSSPYKTYTRFCRLPMTPYTDQDLHRWKRVIRCNIVDVLFCVKHNVFGKWFELVIIFDVNGKIFGVDDEQIIFLAHNITEFLKIGCLRFNENRRLHGYWFERTNDVRNVEEELSRQINCPWGNTCKRKKRNIFKQPLLWKSVGRKNNSAHNVL

SEQ ID NO: 95 - protein, 82 aa, herpes simplex virus 7
MTHETPPPSYNDVMLQMFHDHSVFLHQENLSPRTINSTSSSEIKNVRRRGTFIILACLIISVILCLILILHIFNVRYGGTKP

SEQ ID NO: 96 - protein, 171 aa, herpes simplex virus 7
MLFGILFFLEMVTFVNMSTVSSTPTLEMSRTSDFSSTSITSDTESTSDLMSVSMSIPTTIATTKENVESTSLNFTKTSTFSSGSTTNHENSGNASEFFTLTISTPELTKPQLLNSPLKKFVLFLVILIAAVSFIGIVALALLVLLIKNPKRNHSKKPKNAYNNQAFIGVWD

SEQ ID NO: 97 - protein, 430 aa, herpes simplex virus 7
MWTILLFCVPVIYGELYPDFCPLAVVDFDVNATVDDLLLFDISLSKQCSDDKIRHSAVAAMTDNAFFFGNSETQIETDFGKYLAFNCYQVFSTLNHFLFKNFKKTKGLMKRYDKLCLDVESYIHIQIICSPFKSFIRLRRMNETGISPRILETTFYLQNKRNSTWVAIKNYLGEDDPFTYRIWHTLTHAKNFLINSCENDFNQLFFWQRKYLSLAKTFEATFKQGFNPMIEQRNEQRYRTNNIDCSFSKFRQNGVKVAVCKYTGWGVSGFGSLEVLQKIKSPFGEEWKRVGFNSTGAFTPLYGSDVLWGLIFLRVEMTTYVCTCTNKNTGTQIQVTLPDVDLDLLDSEKTSSNVFVDMLCYTLIAILFLAFVTAVVLLGVSCLDGVQKVLTWPLQHIQKEPVSEKIINLTNLMFGQEPLPKKESLKQQCL

SEQ ID NO: 98 - protein, 325 aa, herpes simplex virus 7
MSKECGLTTMLRCKEKLIAASKDLKFFEKTVQEIMKDGVSIQHIMCINIRICDMTDILPERRLKRLVNIGFYPFEGKMVMFGVAEEWVSASGTPRRQIVFLLSLSQHVFAYEDGVMFYLSPTFEDFWTTKLEFSCQNAITHGMSKKMSRDECHERFINYYHRIRQKTINISGKLPARFQRVLPGHKLSNDRETQAEKMYMSIGYSENDNLPNNCKIYKMCHTPGVTILVSRSTQTGLGHFTRSTQTSQNDIFFKERCYKPQTTAEMYPYKEVNTANETETAPLDMLEESSNFSLETYEEIANSPLKNLEHTSTSGFPVNFEQFTE

SEQ ID NO: 99 - protein, 295 aa, herpes simplex virus 7
MGKEMMFFVFLICLSLTLMSNLKCHQNIIFLDNKLEAVCVTTCYVNEMLIGNSSCLSVRTAFLISLSLKTEGFREMSLVNLTTTSHKLTYLRVLINYYFRGVMLRALIAKKWHFASRANSTLECWLEGHNSGGSITIMTGGQKFLLQLRSGIVAVKWRSVGKDKNKTLEILNQKFNYDCYFVAMICPHLSDEIYQRKVLNPNFTIVRNETIYKRFLRKTWKSSWLDWYKYKELEDLSASYGGKNVIFLNDYESFLDQTQATTIGVVFLVGGSAMVLFLFFCLSIVNRRKVDKNVG

SEQ ID NO: 100 - protein, 88 aa, herpes simplex virus 7
MAESEQKVRFRHALANLSLVKQAFYRDSLSDFVTQNSGCEIFIRWPQSRKIIISPLRDMPFRTTSETELQDLCKLQKQSKHFQCVMMF

SEQ ID NO: 101 - protein, 106 aa, herpes simplex virus 7
METWRRQRLQEFRELCPLQILMTLSNIISKVETIYIKYLFQMDFNTTYRFIFSGLTLTTTVTKSVVIEALFIIKRWQEIKQIFNLDVHKTEDCYIVAQFTHIPVKR

SEQ ID NO: 102 - protein, 755 aa, herpes simplex virus 7
MKMSHLPFAWISDEAKCFLSRFFENISSLPVVDIRENPWILSQCIVKTGNSINNVKTLYNNLILWIYFHQTLCKKKPDYEEVWQEILKVQKILKDYLEQRQMITDYSSLTSFNKVGFETEFKNVAKDLLKLGSFLRWGTVTHAADYVNLTTEERAEIGENLQKAKNNMLSFTIYQIVDPWNENGYYVTNINRLLYLGNLLITLHGSWMNMEKLALNTINEKKNAILKAIENNKNFVSIYSYQILSLPLTSHRVTSFFKILTEDFDVITKSLELHALPVKSTWDDRVKFTPEPIQTFKVLTDLSKSSLSNQFESSSKKTSHGSSFNPEPFIKTEQRSNNTLSKDLFVGSEDGLLSSVKKDSMILDEPRNSTSINNSKKMHRILQTEILDLTDQTMHRPEDKVNQFNEIAVAPDGINQVIDTLSKLDLHNSNKVIDIVSSPKVNVVQLPKNKIDYHSTFFLPENEVNRQNGVQSRDQLSKNSTNDLQKILELRERIKTIKQNNEDIFKLPSEKRRKEIVHENLQSFDDEHNEMSLPPQDQKSIKQKNGNKANSSTKTLNMIGTNDVNASMKEKESASSAKKNQLVKDVKWTPSSSLLDLSRRNDLLQKELFESGLGEKVKKLLTDFTDTISLEERSLKDVLEPPKKTDVSNIATFNDNNLKNLLNSRKRDPLFQNFSFTEKMQPVRSPFFLPNAEIQDFDSGSLLTGKETQNTIFGASKAQENGDKDLIDLENSVQKDDDIVNKLVSHLTHSEEDVV

SEQ ID NO: 103 - protein, 362 aa, herpes simplex virus 7
MKNFETMAEQYKTLPCVGQLNDGLLRELKNLCRFTDFPGIRLLTERHRNECLSLIWPKNLWLRLAQPVDVAGYSEQQLAELNDHYQGFKENLCLIGAIQIGRKDVPIFVGKSSRIFCHDLEDDVLYYIAEDFDKFVRFGILGTNVITCSEPVYTRFYYDGPKFEKLETLKDLGLLQEPLNLNSSLRFNRKTALALKALRRNYISMLSELDELARCKTLAEIEHFVSINTGLKLRLETPIFTALILQDRKNIHCGTSDQKRFEEQEALFEKVVVLGFLNISAEDYGLRPILCIGETGAIYYYDWIDKVLTRIADCLLTFARIGFARYCGDFGYDKIGKVTARFGRLSTLGSAPVQQYSWYLSK

SEQ ID NO: 104 - protein, 865 aa, herpes simplex virus 7
MEIVRNGIKCCLAWPPNYVLIFGEFYHFKCRRSVITYDWSNLVGADEFLCAVGYAHPNYREPDPDFDPFVMYCSSNKMLALDTVTDELYIIAESPAHFCSIGLRNFPPFARIELDIELDRLWYGETKCSGEEFVLLQKNIPALKNFVNRQCGQKIRIDAFQNFDLSFCSSNDIHYITGSGILEKILRRKYVVIGTCARCQVEPNCRAVILLGPNFHIYVYCDNKINKVARSIREFIRRGFEELLYKERYALNWHDDSLIYVSESEAENLNRMLNGESPILRKKPRHMYPRCDRYVKIKVLLFGILYTILLLMVPWMFFFRLLKNMPSILFAVHSSEISNPLVQSVTKFLHPIIIPNGDTELKYIVPVTESRLINGLQASAAGRFGIKGLRLCSDGVIWNRLIDYEYEMFKYPSTFTRADKFLLQLRDLKFMEDFDPKWQCITKLAAVGFYSGASLFNLGAKPGIGYWCRYLCEYLSMLFFKLDGKLKELSKESKQKLGGFSCAFWSESFKTEMQNKTESFFRRDFFDRFQLYLLEHFLLFCGCEECRYNFFRFKNVGTMKKNPGSVKLHFFPALGKIDLPIFPHLSEKYSNLSMFVAKDLCLSFIEGQIEHSRFPISVTVDMGQDKRNLLNILSNIVFLLFIIQTLNSVLFTELKMYYDVYLDELKNLESSMECEMKLGSKGCMNNIVYFNMLKQVKDIVRNPGTSSNFIFNCLEVIKMSFEIPYYKNYDETNFMESFYLHHLYIQRQPAKHTDLVAANNLAPGFFIVNAKEKSFIDVLERSIVNIEAEYLSNTKNINGAMALFFSGLKYFGNFGNGNFQTSPEKDVRAVGYKLGGLDKIQNDLCYFANVETLACVGVDASDGNE

SEQ ID NO: 105 - protein, 542 aa, herpes simplex virus 7
MDLIDYDVCKGPLRNRITYVIPNHPYLSWTAFNSCELDVNLNELTEEMIADSGHLTSEDLFQTRGLKFYDDSLLWAVLVEKNSVSFKRRDKATMTLDGFLAFLQSLRFEECTSPFYRVLTKATALAHFTIAEYFVAGEKRDTLSSHFNRLMELLDSLFLQFFMLRNRCDSNILLSLFELLPNPKEIAGEVVAPSNLLLKNFLDDKIFFSFVMNYHFVVSNLCSCGECRKALFSRFLKRRERGVLHLSDIQDFSPQDLILQQLHLTNDEALRVRESIDKDLGAELILKAMESKTLPILHDEILGNSHLERNILKIYCNIILCLFLARRVRERISRDLDKIARFFAQSLVFLEIRILPFEGVENVCRKLAVLGSHFSSHNVMSIPRHCSAFLEVASILVASYSKQNHRVRALLEHLCQKKVALTCSCFLLHLARELRHDILEGFTNPLKLHYMDNPVRFFRCQDCNLYGTHLWSGLFPNVVPHAVRGGGSFEVRIFEHRMRQRRVSVRKRLFKESQHRGFTIRQSRRIPRLAFCPFAKPVHKDY

SEQ ID NO: 106 - protein, 384 aa, herpes simplex virus 7
MADLGSDFNFEERVLRVVAKDLKKENSFIRKYVAHVDGKKDLKVANVEKTFLSDKKRKEKIFESAKAKLVDFLRVYTNFNSLKMFLFLNPHLRVPLVFPEGFELVLTYGVEGYEEDKLKKYAALVCCPEELTVLGYIKHTVTTVYELEYETDDVVILLGKVGRVYAHTTLFPDQLCRVGDTIDSFLRKGLKRCLYAYVLCKCLQFEVSDPEIEAITTCAEILAFRDRHLGEKFELRWPARENILFHHRKDSFHFVSDPEIKSVLADMCFFASFGLKCFSDGARISLYADCSGKIYGFNDNDPDGNLTFIAESFQVFRFVGVRNFYKHHTFYAAQPKWCQKPLCHFSSRFYLKTARQGDCDLLFLAARADERAAFPDVGTQIFRC

SEQ ID NO: 107 - protein, 359 aa, herpes simplex virus 7
MSDSPLLDSGVETAVESNASNGLFNLESNTVESPVPEVYWTTFLQSFAAETVSFGDVAHFVLQYAHHRLPLVWPSGAELRFASSEMLGISEDEVCKLTRNFVCCPFVDVWVIGLVLYSDLSALMLIGDRGEFYAFNRSVDNAIYRVADTPYGLWKRGLRRFDPVYAFFESIVSGGFFFGPMCGVEDVLNFAVAFDKALVPLPWPKGVLFEFSVPEDHGERWRFIPRRGVAVVIGKFVGRCLGRGLLRKQRVLMDRLGAVYALDVRGGAVVSLACSFRVFLAMGARRLFKNYRFPDRNAWAMQLPVTCIHVPVVQLPREYSLCPSALEAYRDTELSPDTLSDLCCSRGASEELRNYEILF

SEQ ID NO: 108 - protein, 98 aa, herpes simplex virus 7; identical to SEQ ID NO: 60

SEQ ID NO: 109 - protein, 82 aa, herpes simplex virus 7; identical to SEQ ID NO: 61

SEQ ID NO: 110 - DNA, 1065 bp, herpes simplex virus 7
  CDS (1)..(217)
  CDS (290)..(1062)
atggccgaaagtgaacaaaaagttcgatttaggcatgcactcgcaaatttaagccttgttaaacaagccttttatcgcgattctcttagtgacttcgttactcaaaatagtgggtgtgaaatcttcataagatggcctcagagtaggaaaataatcatttcgcctttgcgggatatgcctttcagaactactagtgaaaccgagctgcaagacctatgtaagttgcaaaagcagtcaaaacatttccaatgtgtcatgatgttctaataagtttttgttgttttcataggttgctatctcctatgttgcaatgaaaggttacaagtcatcggttttctgagtgctaaaaacgacgtaacaacagcagctgctaaaaccatcattcttctcggagaagaagagcgtttctatgctttggacttcgaaaaagaaaatttatatttgcttgctgaatcaacagagcgctttgcttatttcgggttgcaccgttttgatccgatttatcaagatagtgacattcccttcctaacgtctatcgatcacgttttgcaaagtctcattcatgcacagtataatcttgtgaagtttgctgaaataatagcggctaacagtgggaaagtgtacactcttcgtttgaagagggaaaagatggatgaaaaactagttttgtttctaaccagaaaagaagaattccctaatcgcacagaatggaattttctagctgacgtttatgacaatatgccatactatggacatatcattggcagcgtcggtaaaaacttaatgtttcctaaaagtttatttttaatgatggatttaaaaggttttatttatggtattgacgcaattggaaccgggatcggtccctgtgtcaaaattgcagaaaattttgaatgtttattaagacaggggatagttagaacatatcgcacatacaaattttttccaaggaatttaacaattactcatgaaatttatccgacctgcccacacgctgccggattagctatatatttaagtgaggatttcagagaagtggatacatctgatgaagacgaaatttaa

SEQ ID NO: 111 - protein, 330 aa, herpes simplex virus 7
MAESEQKVRFRHALANLSLVKQAFYRDSLSDFVTQNSGCEIFIRWPQSRKIIISPLRDMPFRTTSETELQDLCCYLLCCNERLQVIGFLSAKNDVTTAAAKTIILLGEEERFYALDFEKENLYLLAESTERFAYFGLHRFDPIYQDSDIPFLTSIDHVLQSLIHAQYNLVKFAEIIAANSGKVYTLRLKREKMDEKLVLFLTRKEEFPNRTEWNFLADVYDNMPYYGHIIGSVGKNLMFPKSLFLMMDLKGFIYGIDAIGTGIGPCVKIAENFECLLRQGIVRTYRTYKFFPRNLTITHEIYPTCPHAAGLAIYLSEDFREVDTSDEDEI

SEQ ID NO: 112 - DNA, 5108 bp, herpes simplex virus 7
  CDS (1)..(864)
  CDS (3981)..(5105)
atgttgcgatcatgcgatatagatgcaattcagaaagcgtatcagtctataatttggaaacatgaacaggacgtaaagatttcttcaacttttccaaacagcgcgatattttgccaaaaacgatttattatattaactccagaacttggctttacacatgcatattgcaggcatgttaaacctttatatctcttttgtgatcgccaacggcacgtaaaatctaaaattgcaatatgcgaccccttgaactgcgctttgtcaaagctcaaatttactgcaatcatagagaaaaacacagaagtacaatatcaaaaacatctagagctacaaacaagtttttacagaaatcccatgtttttacagatcgaaaaatttattcaagattttcaaagatggatctgcggtgattttgagaacaccaataaaaaggaaagaattaaactagagccatttcaaaagagcattcttatacacataatttttttcatctctgttacgaaattacccacactggccaatcatgtccttgattacttaaaatataaatttgacatagagtttataaacgaaagcagcgtaaacatacttaaacagaaagctagtgtttttctagttcccagaagacacggtaaaacatggttcatgataccagttatttgttttttattaaagaatttagaaggaatcagcattggttatgttgcacatcaaaaacacgtttcgcactttgttatgaaagatgttgaatttaaatgtagacgttttttcccgcaaaagaatatcacctgtcaagataatgtgattactatcgaacacgaaacaataaaaagtacagcactgtttgctagttgttacaacactcacgtaagtaacaaatttttcttacctacttactatgcgtttacagactggacaggaaaggagtattaatctgctaattgctgggtcaagacgaattaatatccagtttgtattccttaaaacgactggttcttgattcttatgtccatgtacgtaagcatttatatcagttgaaagactagtgggcttttcagggtaaattagatcaagtaaatcgagctcttgatcacataataatgaagacagatcttggttggaaatcttagccatttttttcttgcatggggtgtaacaaaaacatgtttcttgattatcagtgcatccaacggttttgccagtttgttctacgtgtttactatgatccttacaaaaaacacaatgtttattattgcaggaaatcatatcaaaaactactttagataatgatggcaaagtgtttttttcaaagcaagccagatataaatcgtacaccaggacaaaagtgtacacataataacgtcccatgttgttgagacaccaagaaccacaacccaaaggaattaatttattttctccaggtcctttaacagttaaaagtttagcttcgtcataactaacaattgaacaagtatcataaattagatttggcgtaataggtcgcacattcagcacatgttcactattgtattttggaatgaaatgtaaatccgttaccgttaaagatcccaattctaatatgtagtacaccaaatcgtttgttattataattttttttagtttaatggaatttgttgcaaactgtccggcatgtattccgtttatggccaagctaaaaacaaaatccaaattcttttttaaaataattatattacagtgcaagcaatctttaaatttatcaacagcgaaaacaggagaagatgttgccacacaacgatattcgtggtacaacttttttttacacaccgaaaaccaattacactcattttgtaaaaaactcctaagacatcccaaattgccaatcgaagaaaaattcatcgttctcttttaatttaaaagttccagacacgcagaaccccccgggtaatacccaatacagctttaaattctcagacatatatagtgcataacaattaggctgtaattcccatgaaatgttttgattttttctgaatgtggagtataagctcgtttcagaatttaattgccaccgtactttctctccatataaggtttttcccgtagtgcaatcaattaagtcagcccaaaattcattcgaactaagtgagcttctccctttttttttatgaagaaaatgactggccatagcttttaaaacacaactatttctatctaaagacaaaatccaaaaatccctcgccaattccataccagaaattaagtgagtacaattaaactctatttgaaaatgactattaaatttttgtggaagatgtctattctgaatttccatgttagtagtaatacatcgaaaagttctttcagcaatctcgtctagatatgtgttgactctatctaaataattcgttattgatgaaaacaaattttcaggaggaatttgaatatttttaatttgcatttgtatccctttcgataactcataccaaaaaatgacaagcacatgtctttgttgaatgtcagatatgaagtcacactttagattttggctgtaccacgaatcacttagaaaggttacgttcgctttttcaggccttgatattggatgactatgcctaacgttcgcagattgttttaatcctctaacagttgatggaggttctaacggaccatgatggttgaacgaaatagggtcttcctttgtgagatctccaagttttgcaggaatatggaaaaaaggtttttccacctcttgttttttttccactgttttttgcatgcgaggtgctccagacaaaatttccgataattttatgacaatatcatcgtgcaaaaaatgtgggtaaataatttttagaattaaaatatctgtatcaaaatgtaggttatcaatatttatgggaactgaaagaattaatgccccatgtattacttctttaatacaggcattcttaaagatttgagaaattacaagatcatgtaacacataagtaaactttatttttgtccattccgtatatacaagcttttctttaaaaaatacacactgaaaaaagatcccttctatagcttttactttctctttatgtataacatcatccagtaaaatacataaatgtaccggtaaaatattattttttctgcaagtaaacattgtttcacagagcaagtgcatttccatattcaatcctcatttttttaagtatgttatcctccctctttcttctactaacacgaatgacattattatcgtaaatagtgccttccgcgtggcctccaattattaactgaacaaaaagttgactgacagtagtaagaggtaacttattcaaggtggagttcttaaacaccttattaaatgtacaaaaaacagcattttctacttgttctataaactttccatcttttataatgtcgcgaataatgtttgaatacctggctttattttgtattaaaaaactgtaaacgtatgataacagcactacaactacattaacggtctccatatttggctcttcagtaggttccatacaggtatgtgaataggctggcatccatccgttataaaaaagcccggtttttgaacacacgcatccttcatgagtatttatcaggttgcagtcttctagcatattgcaaaaatgtatcttaaaacaccgaacacatataaagatgtttcccaaacccatttcaaatgtcagaggattatgcaaattgtacatttgcgaacattctccttcacaagcaactgtgattgactgacatttaggcaagtccatcttttttttgttcattatattttaaaagatcgttaaaaatttccaccgcgagcgtatcatacatcaccgcaaccaactcggtttttttaggaaaagattctaccggttcaagaatgaaatcacagttcagacaaattttttgtatcaacgttaaaagatctgttttagtattacataaaaactcagtctttatatcgtttaaaactccgttcattttcttctcagagtatacgtggtcagagctttaatcttctcatcgttgatgaaagccattttatcaaaaaagacgcgtttagcacaattcttggatttctgccacaatcttcgactaaaattatttttatatcatccacaaattccggaaatcactctacttccttcttgacaaaactaagcaattccccctttgaaatgttaactgtagtatcttatgtttgtgaagatcatgtgcacatactaaatgacagaggaaatgcaacaacctgtgcatgttaccgactacataaaccgaaatttatcagcatcaacgctgacgtcaaaaaaaccgccgacctatttttagaaggtgctttcaaacacgaaataatgggtggttctctctgcaatgtggtaaatgataccttgataacagagcaaggactcattgaattcgaccttttccgatatagcacaattagcaaacagataattccattcttaggcaaagagctctacatatatattgatccagcatacacaatcaatcgacgtgcttctggaacaggggtagcagcgatcggaacatatggtgatcaatatataatatatggaatggagcactattttctagaaagtttactatcaaactccgatgcttcaattgctgaatgtgcctcacatatgatactagctgttttagaattacaccctttttttactgagctcaaaattattatcgagggtaattccaatcaatcatcggcggtgaaaattgcatgcatattgaaacaaactatatcggttataagatataagcacataacatttttccatactttagatcagagccaaattgcacaaccattttatttactggggagagaaaagagattagccgtagaatatttcatttcgaattttaattcaggttacattaaagcgtcacaagaactaatttcctttacaataaaaataacgtatgacccaatagagtatgtgattgaacaaattaagaatcttcaccaaattaatataaatgaacacgtaacctataatgccaaaaaacaaacctgttcagatgaccttttaatttctattataatggctatttatatgtgccatgaaggtaaacaaacttcatttaaagaaatctaa

SEQ ID NO: 113 - protein, 663 aa, herpes simplex virus 7
MLRSCDIDAIQKAYQSIIWKHEQDVKISSTFPNSAIFCQKRFIILTPELGFTHAYCRHVKPLYLFCDRQRHVKSKIAICDPLNCALSKLKFTAIIEKNTEVQYQKHLELQTSFYRNPMFLQIEKFIQDFQRWICGDFENTNKKERIKLEPFQKSILIHIIFFISVTKLPTLANHVLDYLKYKFDIEFINESSVNILKQKASVFLVPRRHGKTWFMIPVICFLLKNLEGISIGYVAHQKHVSHFVMKDVEFKCRRFFPQKNITCQDNVITIEHETIKSTALFASCYNTHSIRGQSFNLLIVDESHFIKKDAFSTILGFLPQSSTKIIFISSTNSGNHSTSFLTKLSNSPFEMLTVVSYVCEDHVHILNDRGNATTCACYRLHKPKFISINADVKKTADLFLEGAFKHEIMGGSLCNVVNDTLITEQGLIEFDLFRYSTISKQIIPFLGKELYIYIDPAYTINRRASGTGVAAIGTYGDQYIIYGMEHYFLESLLSNSDASIAECASHMILAVLELHPFFTELKIIIEGNSNQSSAVKIACILKQTISVIRYKHITFFHTLDQSQIAQPFYLLGREKRLAVEYFISNFNSGYIKASQELISFTIKITYDPIEYVIEQIKNLHQININEHVTYNAKKQTCSDDLLISIIMAIYMCHEGKQTSFKEI

SEQ ID NO: 114 - DNA, 1176 bp, herpes simplex virus 7
  CDS (1)..(1176)
atgtttgtgaaaaaaacatgtcttttagttttcattgtacattttaccaaatatgtggcacataagttgacaatgtcaataatcaataaagaacatcttgagaaatatgaattgatgatggataactatgaactggcacattataagaatctgtctgtcggcaatactagtatttcgtctttcctcacagattttccaacgaaatttaatgctttgtcttacgtcttttctaccaacaaggacgaatctacattaaacagcattttctcttattttgtctggtcacataggaatcgcagtgttcattatcaccacaattttaacgctgaattcatttgtgaaattgacaccgttttgaaaagtcattatttgttaaaagttcataatgacacgacactgaatgtcaacctgttggatttttctagcagtggttttgacgaaaacatgtatgctaatgttgaattattacttattctcaaattttatgtgcagcagttttgtgttaaacaactcgcagatttttctgcacatgtgaccttcggtcaagatggatatcggccacctgtggtgtccatcacaaaacgtggatctaacataacgtgttcggcgcagctttatagtccactgggattgagtattcaatggaagctagaaaataaactggttcctgatgatttgacagaagaatatttggcatcggacatcttaaaagggaaaaaattctactttttttttaaatctattaacacggagtccgctaattatcaatgtgtggtaattcatcaaaaatgtaattactcttttaacgtccttgaatttaataattcagatgaatattttcaaaatttgtttcacaaaacttacaaacacgggaattactttgaagttttttggatacttttaatcattcctatacttgcctttattttttctataatcactgttaaaaaaatgttttttgaaatttggctgcatgttatggctgttcttaataagcgtaaggaccttgatagatctgatagtgttaaagtaatcatggaaattgatccctgtgattatatatctgtggaaaatttgtgtgcaactgaaaaaatggaaatttcagattcagactgcctgtctaaggattctccagatcttcaaattcacgggaccttagatttcatgtgtcattaa

SEQ ID NO: 115 - protein, 391 aa, herpes simplex virus 7
MFVKKTCLLVFIVHFTKYVAHKLTMSIINKEHLEKYELMMDNYELAHYKNLSVGNTSISSFLTDFPTKFNALSYVFSTNKDESTLNSIFSYFVWSHRNRSVHYHHNFNAEFICEIDTVLKSHYLLKVHNDTTLNVNLLDFSSSGFDENMYANVELLLILKFYVQQFCVKQLADFSAHVTFGQDGYRPPVVSITKRGSNITCSAQLYSPLGLSIQWKLENKLVPDDLTEEYLASDILKGKKFYFFFKSINTESANYQCVVIHQKCNYSFNVLEFNNSDEYFQNLFHKTYKHGNYFEVFWILLIIPILAFIFSIITVKKMFFEIWLHVMAVLNKRKDLDRSDSVKVIMEIDPCDYISVENLCATEKMEISDSDCLSKDSPDLQIHGTLDFMCH

SEQ ID NO: 116 - DNA, 354 bp, herpes simplex virus 7
  CDS (1)..(354)
atgaaaatcgtcgactacatgggtattggtttgaaagaacaaacgatgttagaaatgtggaagaagagctttcacggcagatcaactgtccatggggaaatacttgtaaaaggaaaaaaaggaacatatttaaacaaccattactatggaaaagtgttggtagaaaaaataattctgcacataatgttttataagtacaaccattttttcccagagacctatgaagattgttggaaagggatttattatttgtttgttctgtttattttggcttgcattgcatatcatgattatataagtccttcaatagcagagaatatgttatcatttatcaggtgctctaaatatccctag

SEQ ID NO: 117 - protein, 117 aa, herpes simplex virus 7
MKIVDYMGIGLKEQTMLEMWKKSFHGRSTVHGEILVKGKKGTYLNNHYYGKVLVEKIILHIMFYKYNHFFPETYEDCWKGIYYLFVLFILACIAYHDYISPSIAENMLSFIRCSKYP

SEQ ID NO: 118 - DNA, 882 bp, herpes simplex virus 7
  CDS (1)..(882)
atgtggaatgtaatcataagtttttctatgggccttgttttagggaatgtaattccgggagaaagctgtttccatcttatgataaagaaaacgctgtttgaacaagtagtgctaatattcctttttagcggaggtttgctattgacttaccgtcgggtgaatttgtttaactattgtcctttcaacgatctcaaaattataactttatcattactcgtgttgcaaatcaccgatgaattttttttggtaatctgctcgtttttatttttttctgaaatccgcttgagagccatagtctgtagatgcatgctaatatttccaacgcattcaatggcatcttatttcggcaccctaattgccattgtgttaaaaatatcagatttggttcattacagattgcttgttacagtgtttctgataacgccatatgtaaccagttataagtttctggttaactctcatcagtttgccatgtgtcttcagcgatacaaaccgatctataaaccgaatggcccgtaccaaatggctataaaagatgttattgtttatttgctgcaatttttaaccttaacgctgctggtttggtttggaaaattgtatttaccaagaaaaagttgccagcatttatttttcttggcagtcttacatagtaatttgtttatcactaaactatatcaacttgttctgtgtagtattctgtgtttgttagcaggggtaataacagaacattgtttcttttcattgttgtttgagttctttcttggcttaggttatagcgctctatttgctcaaatttcaaaaacagtgggtagaaaagatatttttacaggcgatttgttgaaccttttttattgttcagcttgctttgtaatttttttctaa

SEQ ID NO: 119 - protein, 293 aa, herpes simplex virus 7
MWNVIISFSMGLVLGNVIPGESCFHLMIKKTLFEQVVLIFLFSGGLLLTYRRVNLFNYCPFNDLKIITLSLLVLQITDEFFLVICSFLFFSEIRLRAIVCRCMLIFPTHSMASYFGTLIAIVLKISDLVHYRLLVTVFLITPYVTSYKFLVNSHQFAMCLQRYKPIYKPNGPYQMAIKDVIVYLLQFLTLTLLVWFGKLYLPRKSCQHLFFLAVLHSNLFITKLYQLVLCSILCLLAGVITEHCFFSLLFEFFLGLGYSALFAQISKTVGRKDIFTGDLLNLFYCSACFVIFF

SEQ ID NO: 120 - DNA, 1434 bp, herpes simplex virus 7
  CDS (1)..(1434)
atgtcatctttaaggaatttgctttgtcggctgatttctccgctgtgtaaacatggttcgtacagtcatttgcagttatttcttattggagatgtcagcaaatctgaaaattgcgtattatcgatgttcgtaacgaataaaaagtttttgagtaaagatttaactgataatttctaccggaagtttttaaaagtttggttaaagtgtgatctggattcaagaaatcagattaaagctatttttaataaaatgatgatgacaaaaaatttctttttgcttttggcatatttgtattttttgtacaggcaatgcaaggttctaaaaattctggctctttacaaaattcaacgtcttacttggaaacaaattgtggagagattcaaacaatacccaatacataagttaaatcagttgttggaaataccgtcgtttgtgtcttttaatgatctctattattatttatttcagcaacagttaatgttgccaatttcaactcattgtaatattccttgtatgaaactcttttgtttacgtaactttgaacaatgtaatgacatcacactgcgatacgctcatagagcaagcaacctgacatatcaagatatatttcatggttgttctttaacagttccatgtggaaattttatctttgctatggccatggccatgatagaaaattattgttacagtttcgatcgttttttaatcccgctagaaaataataacttggtgccgattgttttgaacaaacaagaaaaacatcaacttccaaaaattctaacttttgctttgacgacagtcttgaaaagaagcttaacttcaagtatcatctctttaccggtattatgtttttgcaaaacaaagtgtctcagatatgctaaaattgatagttatctcactgtgatatgttctaaatgtggacattgtttaaattccggcaaagagaggcttaaagggaaacaaactttttctttaagctcgatgttttattatcgagatagacaggaaaaaaatattatttacagtatgcacacagatttgctttattgttcattatgtggcgggcaacgtttgacacttgaaaaagtatatgaattgtatgaatatagtgtttcaggcattcaagtaaaaagtgtatcatggaaagctataattggaactaattccgcttgcactattttaaacgatagtgttaaatttgatgccattgttgcatgttcttgcagaacttgttactctatgatccatctgcagaatctaacgataaataaactgttgaaactaatttctcactccacagaatttcaatgccaagattgtcaaaatatctacagagaaacgtgtcttgatctagaggactgtggagaaatttgtacaggctgtaaaatttctcaattagctaagtgcacgcaacatggctgcgacacgtggtga

SEQ ID NO: 121 - protein, 477 aa, herpes simplex virus 7
MSSLRNLLCRLISPLCKHGSYSHLQLFLIGDVSKSENCVLSMFVTNKKFLSKDLTDNFYRKFLKVWLKCDLDSRNQIKAIFNKMMMTKNFFLLLAYLYFLYRQCKVLKILALYKIQRLTWKQIVERFKQYPIHKLNQLLEIPSFVSFNDLYYYLFQQQLMLPISTHCNIPCMKLFCLRNFEQCNDITLRYAHRASNLTYQDIFHGCSLTVPCGNFIFAMAMAMIENYCYSFDRFLIPLENNNLVPIVLNKQEKHQLPKILTFALTTVLKRSLTSSIISLPVLCFCKTKCLRYAKIDSYLTVICSKCGHCLNSGKERLKGKQTFSLSSMFYYRDRQEKNIIYSMHTDLLYCSLCGGQRLTLEKVYELYEYSVSGIQVKSVSWKAIIGTNSACTILNDSVKFDAIVACSCRTCYSMIHLQNLTINKLLKLISHSTEFQCQDCQNIYRETCLDLEDCGEICTGCKISQLAKCTQHGCDTW

SEQ ID NO: 122 - DNA, 2469 bp, herpes simplex virus 7
  CDS (1)..(2469)
atgaaaattctattcctgagtgtttttataacttttagcttacagctatctctacaaacagaagctgactttgtcatgactggacacaatcagcatttaccatttcgaatttgttcaattgccaccgggacagatttagtgcgttttgacagggaggtttcttgcgcgtcttacggctctaacattaaaactaccgaaggtattttgataatttacaaaacaaagattgaagcacacacgttttctgtcagaacttttaaaaaagaacttacatttcaaacaacatatcgcgatgttggcactgtgtatttcttagatcgaactgttacaactttgccaatgccaattgaagaagtgcacatggtaaacaccgaggcgcgttgtttgtcctctatctctgtaaaacgttcagaggaagaggagtatgttgcatatcataaagatgaatatgtgaataaaacgttggatttgattccgttaaattttaaatctgatactgtcagaagatatataactactaaagaaccatttttaagaaatggtcccctctggttttattcaacatctacatcgataaattgcatagttacagactgcattgcaaagactaaatatccttttgatttttttgctttatcaacaggggaaaccgtggaagggtcaccgttttataatggtattaattctaaaacatttaatgaaccaacggaaaaaattttgtttagaaataattatactatgctgaaaacgtttgatgatggatcaaaaggaaattttgtgacgttaactaaaatggcttttctggaaaagggaaatactattttttcatgggaagtgcagaatgaagagtcttccatttgtttgttaaagcattggatgacaatcccacacgctttacgggcagaaaatgctaacagttttcactttattgcgcaggaactaactgcttcttttgtcacaggaaaaagtaattatacgctttctgattcaaaatataattgtattaacagcaattatacttcaattttggatgagatttaccaaacgcaatacaacaattcgcatgacaaaaatggtagttatgaaatttttaaaactgagggagatttaattctgatttggcaaccgttaatacaacggaaattaacggttttggaaaatttttctaatgcttctagaaaaaggaggaagagggaattagagactaacaaagacattgtatatgttcaactacaatacctatacgacactctgaaagattacattaacacagcactaggtaagcttgctgaagcctggtgtttaaatcaaaaacgcactatcacagtgttgcacgagcttagtaaaataagtccttctggaatcatttcagcagtgtacggtaaacccatgtccgctaaattaattggtgatgtattagcagtctcaaagtgcattgaagtcaaccagacttctgttcagctacataaaagtatgagattgacaaaagattcaagttacgatgctctaagatgttattctcggccattgttaacatattcatttgcaaattcttcgaaggaaacttatttaggacaacttggtttagacaatgagatattactgggaaatcacagaacagaagaatgtgaacaatctaacacgaaaatttttttgtctggtaaattcgctcatatttttaaagactatacgtacgttaattctagtttgataacagaaatagaagctttagatgcgtttgttgacttaaacatagatcctttagaaaatgcagattttacattattggaattgtatacaaaagatgaactgagcaaagcgaacgtttttgatttggaaaccattcttagagaatacaattcttacaaaagtgcgctacaccatatagaaacaaaaattgcaactgttactccaacatatataggagggattgacacatttttcaaaggtcttggcgctcttggtcttggtttgggggctgtgctgggtgtaacggctggtgctttgggagatgtggtgaatggagttttctcttttcttaaaaatccatttggtggagcactaactatcttactaactttgggagtgattggcttagttattttcttatttttaagacataaacgattagcacaaacaccgattgatattttatttccttatacatcaaaatcaacaaattcggtacttcaagcaacgcaatcggttcaagcgcaagtgaaagaacctttagattcatctccgccttatttaaaaactaacaaagacacagaaccgcaaggtgatgacataacacacactaatgaatattcacaagtggaagctttaaaaatgttgaaagctattaaattattagatgagtcatataaaaaagcggaaatcgctgaggcaaaaaaatcacagagaccaagcctacttgaaaggattcaatacaggggctatcagaaactttcaacagaagaactgtga

SEQ ID NO: 123 - protein, 822 aa, herpes simplex virus 7
MKILFLSVFITFSLQLSLQTEADFVMTGHNQHLPFRICSIATGTDLVRFDREVSCASYGSNIKTTEGILIIYKTKIEAHTFSVRTFKKELTFQTTYRDVGTVYFLDRTVTTLPMPIEEVHMVNTEARCLSSISVKRSEEEEYVAYHKDEYVNKTLDLIPLNFKSDTVRRYITTKEPFLRNGPLWFYSTSTSINCIVTDCIAKTKYPFDFFALSTGETVEGSPFYNGINSKTFNEPTEKILFRNNYTMLKTFDDGSKGNFVTLTKMAFLEKGNTIFSWEVQNEESSICLLKHWMTIPHALRAENANSFHFIAQELTASFVTGKSNYTLSDSKYNCINSNYTSILDEIYQTQYNNSHDKNGSYEIFKTEGDLILIWQPLIQRKLTVLENFSNASRKRRKRELETNKDIVYVQLQYLYDTLKDYINTALGKLAEAWCLNQKRTITVLHELSKISPSGIISAVYGKPMSAKLIGDVLAVSKCIEVNQTSVQLHKSMRLTKDSSYDALRCYSRPLLTYSFANSSKETYLGQLGLDNEILLGNHRTEECEQSNTKIFLSGKFAHIFKDYTYVNSSLITEIEALDAFVDLNIDPLENADFTLLELYTKDELSKANVFDLETILREYNSYKSALHHIETKIATVTPTYIGGIDTFFKGLGALGLGLGAVLGVTAGALGDVVNGVFSFLKNPFGGALTILLTLGVIGLVIFLFLRHKRLAQTPIDILFPYTSKSTNSVLQATQSVQAQVKEPLDSSPPYLKTNKDTEPQGDDITHTNEYSQVEALKMLKAIKLLDESYKKAEIAEAKKSQRPSLLERIQYRGYQKLSTEEL

SEQ ID NO: 124 - DNA, 771 bp, herpes simplex virus 7
  CDS (1)..(771)
atgacgttgccagcaagcttaaaaggattcgaaactctagacatattcaatatatcaagcgtccggaatatctgtgaactaaacaaacacgccgaacacgtttccattaaaaatttacctttaattgatatttcggttggaaatgatgatgtatggtttcatttggaagatggcacaattgtaaatggcaaatcctataaaagcatatgtgagaaaacattagggtttctaggcttcattggcattattcttcttgattccgaagatacgctagaagagattcggctgagtaaaactcaatgtaaacgaagaatcatttatttgattttaaaggaagacacggagtttttactctgtggtattgtatatgctctagaaaatctaccaataaaagggcagacactacttaaattacgagatattattaaaaaaatcagtgtaactctgccagtctctaaacttctagcctgcacctgtcaaaaattgattagtattttaagatacattttttacgatgacaaacagcaagacgtactggataaagttccacccattattcagctctattatgagtcaaaaacagcaaatatacacatgttaaatctttttttcaaatctcacgacaatgacgacacatgtactctatcactaaacacgagacgtttgcaagacgactctaaatatttaatagattttttaaaaagcgctatatgcgatgccttttcaaaggaatataagatgacagaaatagaaaaaactagtttacattaa

SEQ ID NO: 125 - protein, 256 aa, herpes simplex virus 7
MTLPASLKGFETLDIFNISSVRNICELNKHAEHVSIKNLPLIDISVGNDDVWFHLEDGTIVNGKSYKSICEKTLGFLGFIGIILLDSEDTLEEIRLSKTQCKRRIIYLILKEDTEFLLCGIVYALENLPIKGQTLLKLRDIIKKISVTLPVSKLLACTCQKLISILRYIFYDDKQQDVLDKVPPIIQLYYESKTANIHMLNLFFKSHDNDDTCTLSLNTRRLQDDSKYLIDFLKSAICDAFSKEYKMTEIEKTSLH

SEQ ID NO: 126 - DNA, 507 bp, herpes simplex virus 7
  CDS (1)..(507)
cgagcctggttttgttccctgctcgccaccgttgggaaagacgtgagcaatacacccagtcgtctgctcaatggtaagcaaaaaaaggtactatctatagttatttttttctccaagaatttgaatgtaaagtacccgcttattagtgaattacagatacgcgcagattttaaaaagatgcgtagctacagcggaatagcctttcggacacaaatatcactggcaatcgtccgaaaagacaacaagggctacgaatgggaaacttgcatgcaattttcacaatggaaagaagaagattttaacatacctaaagtgaacatgacttcagaaaaaccattgtatgacgcttgttgcccggataagaacaaaagtcgagaaaacacgacatacgcgtggcgatggtcagaacatccctggacagagacaaccatcgaaccctggagagacatagacattattagacagatacccacggacgaaaggtgcttaacaaacactacagtgtaa

SEQ ID NO: 127 - protein, 168 aa, herpes simplex virus 7
RAWFCSLLATVGKDVSNTPSRLLNGKQKKVLSIVIFFSKNLNVKYPLISELQIRADFKKMRSYSGIAFRTQISLAIVRKDNKGYEWETCMQFSQWKEEDFNIPKVNMTSEKPLYDACCPDKNKSRENTTYAWRWSEHPWTETTIEPWRDIDIIRQIPTDERCLTNTTV

SEQ ID NO: 128 - DNA, 159321 bp, herpes simplex virus 6A
  CDS (501)..(794)
  CDS (2746)..(3048)
  CDS (4725)..(5036)
  CDS (5629)..(6720)
  CDS (7237)..(7569)
  CDS (8245)..(8616)
  CDS (14619)..(14867)
  CDS (17604)..(18914)
  CDS (21856)..(22812)
  CDS (22898)..(23218)
  CDS (23316)..(25145)
  CDS (41884)..(45132)
  CDS (45150)..(51383)
  CDS (54252)..(55706)
  CDS (55710)..(56504)
  CDS (73446)..(74087)
  CDS (75291)..(75545)
  CDS (80277)..(81035)
  CDS (82574)..(83479)
  CDS (84281)..(85867)
  CDS (93924)..(96242)
  CDS (98427)..(98684)
  CDS (99260)..(100588)
  CDS (102458)..(103519)
  CDS (103866)..(105554)
  CDS (105562)..(107028)
  CDS (108325)..(110667)
  CDS (115100)..(117574)
  CDS (120164)..(121198)
  CDS (123528)..(123821)
  CDS (131034)..(132275)
  CDS (136266)..(136481)
  CDS (136485)..(136829)
  CDS (142941)..(146306)
  CDS (151734)..(152027)
  CDS (153979)..(154281)
  CDS (155958)..(156269)
  CDS (156862)..(157953)
  CDS (158470)..(158802)
cgcgttttaaaaattacgtcaaatcccccgggggggctaaaaaaagggggggtaataaccctaaccctaaccctagggctagccctaaccctaaccctaaccctaggtctagccctaaccctaaccctaaccctaggtctagccctaaccctaaccctaggtctagccctaaccaaaacattaaccctaaccaaaacatcaaccctaactctaacaccaacgataacactaaccataaaactatccctaacactaaacctagccctagccaaagtactaaccctaaccgtagccaaagtactaaccctagccatacccctagtcataaccctagccataaccgcataactctgttcacaaccctaacactaatcctcgcatccgcacctaacgctgcccctctttcacaccatcaccccctgccgcttcaacttcaccttcttcctccatctcgccccgcttgtttctacacttgtccgcccctctattcttactctaggatgccgctaacggtgcgtgccgggcacgcgccatatcgtcttccgctctccaattattggtggctactcttgggtcgacattcccttcgtcatgttcattcctacctgcgtctgcacaagggtctacgcattcctttaccttggcccgagcaggaatgcctacatttacatcctaagccttacaagtgtctcctgcgttacccctgtataacaagacaaccgcatcttcttcagggctggcctacgaagtcttctctatgtgagtgtcatatacatttccactttttcacatgatttattgcgttttgtctactacaccgggtacattttggtttccctcagggttcgaccctaaaccctaccatccttcggccgacagcaagttgctaccgctgggcctaattacgctgtccgcctgttccacgcgcgtgtcggctacgacacgctggagcagcttccacgcgacagatccgtctctcagctggctgacaggatcgtccccttggctcgtgatcctacaagggcagggggggtctctgttctgccacgacgtgctgcaaggccgactctatatcctgtcgcactccgtgtcgctctttctaaagacgggcctccgccactgcgaggccatctatcgcgcaccgctgtggcgcgaccgacccctgccgagcctgtggacgtgccgggaccccgacaaggccttcttgccgacattactggcgagaagcgcccgacgcggcctggccgctttctacgccctgtggagactgcatctgggatcgcgctcggagctctcccaccccgtgttggagtgggagagcacagagctggtcctgacggactggagacgcgggcgaaatgaggcacagagagacgcgcccagcgtcgcggaacacttcgcgaggtgcagaccgctgctggacgaactgtgcggagagggcggatggcttcccttcgcgtttctctccacatctccgcacgtctggctgatcctaacggaaggaggccccgtcctggcggttgacgtgaacgacacctccgtgtggcgcatcgcggacgacctggagctgctgcgtcgcctggggagtctgctcctcctctcaggcctccggcttcctctccgtcccccgagcgggagcggcgaggcggccggagagccggggtacgaggaggaagagagaagagggagagcgtcgacggcgagcgcgacggccgcgacgtcgacgcgcggaccgacccgtccgacacgggtgacgcgtaaggggcgtgtggcaaccggaggcgtccatctctccgcacgccccgaatctgaggaacagacagacggccaccacgggcgccaggagagcagcgacgaccaccagcgcggcggtagcggacgaggacaccgcgatgacggcgcgcaccgccacgcgaatgacaaaacagagccccagcagcgcggagagcacgaggaaaggaaacagaccgactccgggcgccacgagcacgcacaggagagccaggtcgcaagaagagacgaggaggaaacggagcagggcgatagcgaaaggagctgcgggggggcgacgcagacgtacggcggcagaggccgacatgattcctgcccgtcgatccccctgtccgtccccgggcccgatccccgcctgtgggtccctccccctcatctgttattcccttcccctctgccaccgatgacgcccgtcgacgacgagccgtccgtccgccctcggtgtccgccaggtcccgcggaggaaccccccacgtgtcgtccccgtccgccccgcccgtcgtccgacaccccgctgtccgctgtctcgcgcccctccgctccgcccgtccccccgccgtccactgcgcgtgtccgtttcttcctctcttcctcctcctcctccccgtcctactctcccgctccgttgtctccgccctctcccgtctctccctcgtctcccagatctccgttcatcccccccatcagatctccgggactccgagcgaaaccgcgggtgtcctccgggcatcccgcggcgttcccgccggcgccctcgtccgcgccggcccgttccgaaagagtcacgtccgttccctcatcggcatctccgtccgcgtcgtgcgtcggcaagtcacagccgcccgccgcacacacggcgtgagacgccgcgcgaggtgacggaggcgacgaaagaggacgggaagaacaggcggaagaacacgaagacgaagaggaagaagatacgagaacaaaatgaggggaacacgccggggaccgagcggcggatggagcccgctcggtctcgcacttccgcgatacccagcgggctccgtcgccgcttcggacccgaggtccgacacgcccccacctcgcgcaccgcctccgccaccaccgctgacaacctccgcatatcgcccccatacacacccagcagcagagtccggcgcacgcacacgcgcggagcacgcacgacaacacgccagacatcgaccgccggaggtaacggagcccgtgcacgtcccggttttagcgggagtgtgtgcgcgcgtaccgtaacaaggaaaacccagcgggacgaaacgatcgacccactcctactatccgccctccccgagcacggtccacacgccagtccgtaaaatcacccgaggggcggatccgctccgcgcccctcgcccgatccgccccgataaaaacaagtcatctcactcgtgccagttcacacggacgcgaccgatgacaataaaaaaaaaaaacacaccaccacaaccgaacgcccgccggcccatccaccttccctcccacccccgctcgagtcgcgcaggcgcgtcgacgggcagtccctcggacgcctctacggcaacgctcctcccctgtcccctcggtccaacccctcccatccccctccccggagcacacacgccgactccgtccgcagaggcggcgaccgcagcggcagcggaaactgtaacggccacgttctccgaacagcgacagtaacggcggcggcggcggttgtcgccgtcacggtagtcgtggcggagcacccggggaggcgacgacaggtaccaccggcgccgagatcatcgccgtacgaaaagagtaccgaatgcaaaaagttaaaggttttttgtaaataaaaaaaaaatagtacgtggaaataaaaaataaaaaaaaatatacaatataatagtgtattataaaataaaaacagaataaaggctaaacaccggccaaacgctcatccttctccgtacgtcccctttccgtaagtgccaaatgccacatatccatgaacggacacacgccggcagaatccggccttcctgacagcaggtagcccgcgacctaagcacaggacggtacctgaaaccgaaagcgtaaagggcggtctcccttgttccgcccatgaggcgggacttcgagacgagccacccttcgtatacgtccggcccctcccacgcgcgcctataggacgcaccccctcgttgcgaaaccgcaacagggcacagttgccgtcacaccccctgtccctagctcgcgacgggccggcgcagaccctgccgcggcggcaaagccgagacaagaccccgacgtacgcgggcataaagaacgagaagtcgacgcgcaatcccaaattatcgcgagactgtttgctcgggcccgccctcgtcctcatgccctctccccgccctcatccccttccacacccggtagacaaaaaaaaacaaaaaatacataggtaaaagtgattttcgcggttaaacatttttccacgtgacgtccccggcgattcccggagatgcgacacgcgacacattggcccgttgacatcggggtccgcagacgcggttcccccgggggcgtcgcgacgtcggttccgcagaaaacaccgcggtccgccgtcacccttcaatcacgcggtatttccgcgctcctatgatatatctccaccgacacgggttctgtctgtcactttttaccgagccgctccaccatcgacagtgtcactgactacatcgcatacgtgctgttttgcctgtttcttgtttatctccccacccctccccgtcacagaccagcaaacaccttgccacatcgacatcgcgggcggcaaattaaaaaaaaaaataacataaatatagtgaaagagaggcccccgtcccacataaggacagaagaacaggcaaaaaaaaaaacccgtccgttattcacacagcattcggaaagccatgtcgacgcgacacacacagaggacgggcggacgcatctcggtccggcgcaacgaggcgagactggcccacgcgcgagcccgtgcccgcttcgactggctgctcctggcccgcggcaggccgtccaaactgtacggctatgcgagccggcatcgcggagaactgatccacctaccgtggccgccgtgctggtgtctagaactccaccacgatccgtacagagacgccagaagtgccaccgtgtggggccaccgctggggttggccagcgacgcacgtgagacccagatgcgttcaagactgcggtgagtaaacgtacgggcgagccgcggggagggatgtcggtcagacagtgagtgagtacaaggttcgtcgagaaccaccagagacaccagccggtagagagtggggacaaaaaaaaaacgtcacgtcaggggcggcgagtaacggaaaacgagtatgaatacgaggaggggagacgaaacatagtcaagtatgtgacgcgccggatcgtaaggcagtaaagccgatgacggcctccggccccagagacgactcgcggagtggagtccagttattgtattttttttgtgattttttttatccacaatccggtatccgtgaatccccgcagaggtactttccattaacgatggtacaggcggtataacttccggaacacggtgattacggatatcctgtctcgtttacgcgagacctctttgttgtaatctcctataacggtaaaaaaaaacacaaaagaaagattacagctcctccttttttctgcgttatggcatcctcgcattagtcaccattcctgtcgcgtgtgcttttcgctttgaattgtacgcgacaggatacgaatccgttatactccacaagggcatagcgaccacggctgtatgcggcatctcccgttccacgggatgcctttgcgtgtgcagatgttctgtgctttttttatacggtcagagaccacagacaaaaataaggcaacgcccaccataacgtttatggtttcttgttgttttgtttgggttaaacgcctcttctatcgtgtcggccggatccatcatgttcaatcgttgacgtacgcgcgtcccatcacagccctagactcctgtctgtacgtatgttgcggatacggagagaaacttcaacccgtgggtttcgtaaagtcgtatgtaaccaactcccagctcgacacgctccgcgtgctcctggtgggcaaagacggagccgtgtacgtccaccacatgagggcggcaagactctgccgactggcgtcgagcacaacggagtttacaagacgagggctgcaacgcgacgccgtgacgtatgaagaagacctagagctgccggaccagcgtatgtgcggaacgaacgcccgacatctgttcgacgtgatcgccgcggccgccgacgaacacaacctgctgaccgtcggcggcctgtgtcagacgcacgccggagtgtcctgcaacttactagagaccgtgggagatccgtggacggcggttccggccgcgcgcatgactctgaccgtgccgcaggttcagtaccggttatggcccgaagcccggagagacctccgccggcacctgtacgcgggccaccccctgggaccgtggctcgtgtgcggcgttctctctcgagagagggagacgcagaagccgtcgcctccgatacgtacgactgtgggaaacgtaccaacgccggggccacgcgaggtggagatcgcttgggtggtcttgactttggcgggacctctgttagcgttctggcccgataccggcaagatctgtcgtctggcaaactcgttttccaccttatggaagatgggaccgcgggccatgagaggacactggacgtactcggccccgggtagacatctccccggggacgcgtggccactgtgcgaacacgtgagaccgcagtggaaagcttccgaggaagagagcgtacctggattagacgccacggaggtgaagtaagcatgtcacctacggccagagacgtgaccggagaaaatcatgcattgtgtggggtgtgtatgcgtggggtgcgtatcggtgcgcgtactcgttttccttccctcttccctttaaccccacgaaaaataaaatccacgaacgtagacagtcacacacagggtgcttacgctccgtgttactgatggcaggtaaccaaaaaaacgtatgtgtcggccgtgatgcaccgccgctctatagcgtagtcgctatagcagcgcccgatgccaacgcgacagggtgagtcacatagatcgggactgcttgaaagcgcgtcgttcgcttcttatataggcaccccggggggtgggaggagtgaacatacaaaggaggtgcgtccgggattggaggcgaacgtagaaaacgaacagcgtcagaaaaatataagaaaaggcggagacacatagccttggcgggaagacgacaacaggtttaaaaatagacagtgaaaaaaatagcagactgtgacgtccaatacacatgtggcgatcatccaatcaacggggtgtatcgaggcgcagagacaaaagtatgcggaagtacacacgacacggtaacgcggaccgaagacagagggcgatcgctagcatggcaagtgtaagaaaaaaaaaaccacgttccaaaaacacctatacgggaaacatctcttcactccctccccgtcccaaccaccgcaacattcacctccgtaatccgttgtcaccgcgtttctaccacggacgcgtacacacgcagacacacagacacgcacaacccacccatgtggtagtcgcgggtgggtacgtagatggggcataccggggtgagacgtgaagacaattcaaaacgacatcgcgcgcgacgtgccaccgtctgggacccacggtggcctggcacggtgccaaaggaaaccaccggctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaacccatcccccaacgcgcgcgcgcacgccgctatgggaggcgccgtgtttttcaccaacacgcgcgccgctgcgagacgcgtgaaaaaaactccccattggttgcggcccgagtcgccgcgcgcggaagacacgcgtgtcgtggatgcgcgagcccccccccgcaccccccgaaagagcggacgacggtataggggcggacggcgcgtagtttaaaggcgagggtgagcgcgaagaaccgatggcgccggcgagagaaggagagagagagagagacgggaggcagagccgcagagggcagacgaggatacgccggaggagagagaacggccgcggtcgttcccgaggagggcccgcgcgcgcgagagagggtgtagagcggacgcgcgtagagacgccccgccgggcggttgacctttccgcagacatttttgcagacccccgacccgtgtcactgatgcaaacacgcgcgcgaacgtacacagacacgccgacgcgcccccaccgagcagactgccacgtgagcgaaaacacacacgcgcgcgaaaaaaaaaaacaacaacaaaaaaatacacacacgcaaaaaaattacacacacggcgaaaaaaaataatttatgtatgcattgttatcacgatgttaacataaaacaacaacaataacaacaacaataacaacaaccacagcagcagcattaactacatcaactacattaacagacgaggacggaatcaccggatgtcgactcctccgtctccgtctcctcgcaatccccacgaactacggtagaagcttcgcaagacgccacgggcattcctcgttctaccatgtgcggagaaagttgatagacggcgggcagatctatcacaggcgcgtgaacgcaagtcacgggcagctgcatggtccacagatgtcccggggggaatcgatggttcttaaagagttttctcacacccatggcgagaaacgccctgaaactatcggagagacgcaccacggctcccccgtcgagactggccgcgtacaccctgccgacctgatccatgagcacccgttgtcgtctaagcagaggtgaagtgacgccccgtccgaagaatctgccgatcaccaccgcgacgccgccgccgggtatgagccgccacctcttctccggcctcccgggtacggcgaactcaaagaaagccccgcgcggccaaggcaacggcacgagagccttatcgaaagacacggcgaaagccaggacgtcgtcaactccactcatgccgccgaagaaagaggcgccggtttcggtgagacacttggaaccgtagacgggctcgaagcgacgcaggccgtgtttccagagaccgaacgcgtcctcggcgagacgatacagcgcgtcgtcgaacacaccgttaaacgcgtagatctccccgcactctccgaccagcaccagcgcggaaacttctgcgaagatagtgaccccgatgaccgtgagatccataccgggacagcatccgtatcggcgagacagcttggccacctcggcctgcgtgatcccgagcatgtcggaggtggcgaacctcagttcggcccccacgggccacgagagcgccaacctgcaatgtgcaaaagtagagacgaagtcccacacgtcgtccgccgacagcggccgggtgacgagagtgcgaacgaacgccgtccatttaacctccgggacctccgcatcgcaccgcaggtcacgtcccgcagagaaagagcacgaaggaggacacagagccgcagatgccagactccaagaagatatgccgagaaacggagagccacaaaacattttattttctgtgcggaatccgagataaaattaaaaatggaaaacaaaaataaaaaatataacgataacgacagcgttaccggcagtctcgcataaacgtctacgatcgcgttaaggatactacgactgttagggaaaaaagacagcgttgaactgacacattcccgacgttatccacgaatataaaaataaaccgtccgctcgcaaaactgtgaacacatccccgggtaaaatatacaacgatcccagacgttagaatcacccgtaaaaactcgatctatcgcgtttccattctctttatttttttttttttactcaaccacccacattcgggcgaatcatcgaaccacgtcgtgtacggcactcctagtaccagcgtccggaaatttattgcgctcgtcgttcctagctattaaaaacagcacatcagcgtcggcttgcctccaagttttctgataaaacattcgcgatagatgacaggtaggaagaagcgcccattcgggttgctccctacggaaaacgtagctcttataatactgagtgactcctatccgtctaaactgctgaaaatcttccgcaacgaagcgcggccgtccgtcttcgtcgttgtcgttaaatccgaaaatctggccgtcgtcggccacgtagagagaaatccgaccttcgtccccaaagtacttgtatccgaagctgccgaagaaacacatctccgcgagcctgcgccgcgcctcgtcgcacatgacgaaggcaaaagaatcccgccgccgatgaaagagcagagtctcgttcttgggccacctcagggcgaaagaacgacctatgtgccggtctcgaaaacacagcacgtcccgacaactgcggacgccgtccacctcggggtcctccaccacaaactgcagcgatgacaccagctgatgtgcgtaatagaacctcttcagacctttacgtagaaaatcgtcaatggtgtcaccgacgcggcacagttgctgcggcaataaccacgtgtgcgcataaacacgaccggcgccgccgagcagaacgactatgtcacctttcgaaaaccagtaacacggctccgatccgattcccccccttttcttcacgtatcccagtacgacgaggcgctccgggcaacacaccagaccggccagttcgtccaacttttcatcggcatattcattctcgtctctacagttattgatgaccagctggtatccttcaggccaagccaaaggaatccgcctgccgaaatttacgaacgtaaacattcgaacgctattcaggcacgtatagacgcgcaggagatctacgagatctctcttcgactcgttatagacacgttgacgtgtcttggtcctctcccgagactgcagctcagcattcccacacatcgtagaatcttgcgctggctcatgaaggcctccagtaaatcgcacacgccggttctttgtcgtttccattacgggctcgcagtaacagaaatagcacccaaaacttacagactaagcaaaagttgcaaaaaaatgaaagataatatagtcacagaagaattctgtcacaatgcacacccaagaacaacgatatggatgatcacgacaacaataatatcgttttttctttgtgaaaactaatcagtaaaagcgtaccggttttccggattcgtccgtatcagataaaggtcacacaagccggcttaggaacgcggcgcgcttcacgaatgtctaaccctcgttgctgcacgcgtcttataagcctacgtctgacgactattcgcttctgacgtctccggtgctcctgcagcctgatgtcaaacgagccgccgccgcgcacagcgtaaggaacgacgttcggatacaccccactccacatatgggtcccgtaaaggttgcagtcgtgaaaacgaaaaaacctaaccggattcgacatgtaagataactccagagtattgaggaagccctccaggacgtcgtgccttatctcgcgagcgagtcgcatggatgcacacaggtcgccgagacagatctttttaaggcacagatgctctaagagagcacgaacgcgatgccgttccttgtcataacccgatacgagaatcgccacgatctcaagaaagaaaaaacacaacctagggacgcgcatgggatctttaatctcgaactgagaactgacaactaacagtttgatcctgacaccgcggaggccagaaacggtatcgatgcaacgctccatttcggagatcgcttttacgaagaaacgagcaatggcagtgagatcactcacgatgcgctgtttgacgcgtctcagtagaaacagacacagaacgatgttgcagtacaccttcaagatgttacgttcaaaatgccctctccccaactgcttatcatgaagaatgggcaaatgccgcctttccatagagttaaggatgagagaagagccgagatctcggtcgatctccgcccggagagcgaccgcctcacgcgcgtcgaggtgcagctggcctaaaatgagatcagccggatcgaattctgaaatatcggatatgtgcacggcccgggaatctttcttacccagatagatccgaaagagagacgcccggcactgatcgcaactacagagcacagaagacacaaagcgataagaagaagcgtacgcgacaaagatgtgatcggacaaaaagtgtttcaagagcacactcgtcggagacgccgcgtcgccatagatctccttgggattgggcaaaatatcgaacagggtcaacagagtattggactcgctcctgttcctcaacatgaggaactgcaggaagagggagtccaacaactccaaaagacggttaaaatgcgccgagatagtatccctcttctccccatcgacgatgtactccagaatcgagaagtgcgccagcgcggtgcacttggtcaggagtcgataaaaaactgacgtttcgtcctcaaaagttaaccgttctaagagagacataaaagccgagagatccatggtcgtctttccacgcctctggaattcaacagaaactttctccgccagagccgcccagagaacactatcgtcacaaaatcgtaagccgcgggtcataaacagatcctctgcggtcaacgtgccgctatctataatcatctcctccgttatgtctttcagatcaacatcaagttccctggaatgatgaacggtaagcgagagatagggatggttgggaatggtatacgtgacccgttctcggacgggtcccttataaatgtcgtggtccaataactccatcactcaagtaagtatatatccgagacagcgtttattttccgtcgcggaaaaataaagataaaggagcagaattcaaattacaacagacggccacgtacatcacaatcgagaaagcacacaatcactcatccccaccatgtccattcagttcgccgggacaatccggtggcgtgtattcataatacttgtaatcatccctgaggacgtccaacgaccccaatttatatgcgatagctctgacgtctttctcgggacttatttgaaaaccgcgatgattgccactcccaaaatatttcaagccactgaaaaaaaaagccatagtcccgtttatgcacctggtgttagttaaataatcttcgacgacgggcaacactacccgttgtagccgctgtaagaaattctctccatcggtattaacgataaaaaaccccggaatgagattatcacaagacaccaggtcacgatcattgtcctcgtgaaagcgttttatatgaagatgatgcataaaaaacatttccatgaacggagtctcatcgtaatctttgtaggcaggaacggaaaaaccgattctcagagcttcccaacactttaagataaactgactcttttccccgggacacctaacaatttctttcatctgtttcatcggagaaaagtaacacaggtctcccagacacccattccgccctagcttcatctcttcctccatggccacacacaatttccccacttcctccgtgaagaggtcgtaatatatgtccaactcagcatttatgacacggtagagggtgttcacaacgaagacaatgaagacaatattagttaagaaggttagcaatgccttcttatccggagtgacagagatctggagcgaaataggcagcctactgagctctatctgaccttcgatcatgctcaaccctaaatccttcgctatgagactcgacagactcacatcgtagggttcaccaagatgcagaaaagccggaaggcgaattgaacctatcataggaaaacactggattcggacactgtggccaaaatcaaacttcctacctctcttgttatacatgatgaacatgcgcctacactcgacacaaccacagaggagcataaagtgttcgataagacaggattcgatacgctcgaagaaatcgtacctgaagaaaacatcggatttgttttccaagcagtccttcaattcttgaccccaatgacaaagattataacctcccagttgccgagtagattccttggtcaactcttttaacttgctttcaaactgaaataataacatggaggcatactcacttagataacgacaccagtagcccagcgttggtttggacgtgaagttaaacagagacgctccggcatagagaccgagaaaagccagtttagtgatgcactgccacttctcattaaaattgtccataaattttaagtctttcaccatgtccgcaatctgatcggctctgatgtaggtggaaggatacttgtaagtttcatactcataatccaccagtatgttccacaccaagcagtccgaagagggatgtagtcctttaatgccaaatctagctgctgcggtcccctgcagaccgttcgtcaacctggcgcgggagacgggaacaacaaacctgttggtagcgggcagtcgaccgacgaataccggcgtgagaaattttgtgataaatttaaccgtcggtgaatcctcttcatccagacgcaccgcaaacagaattttgctacggtctttcacaagcctgttgtaagaaaaaaaaaagttagcggggagtctccatcctcgaataattatcctctctggaaaacgacacagaacacatccacccacctgtcctttcgcacgcacatatgccgaggcttactacggagaacgggcaactccccattcaacatcctattgagattctccgtctcagtgtcacttatataaaataaggtgtcgtcactccaatccaacgaatacttctctttatagagcaactcatcaaatcctctacgtatgaaagtcctcaaacttttagagactttgctgattttgttttctacgtagatataaatgtgacagttcgagcccataacgatagcagctctgcaattcggttcagcctgagaacgggcacacgtccctatgatagcataatccttttctgtgattttctctagaatgccaggtccagtcagataataaatatccgacaaggaacaaaaggaaaagtcaaagtcctggaaagcatccaccctgattctcttgccggaatgttttgccacgtaatccttcatagcagggagattcctctgtaaaaggataaattcctcccggccgcatttagtctctccgaaccacatcttttcctgctctggatctaactccgcttcggcaaaaggcggaaattgtctaagtccaatattgaagaactgaaccaatgattctgctatgatgtacactttctccgtcaccgtgtccacggcaatggtctttccggttgaagtatgcatcacgtatggatcgtagtcaggatttggatcacgatatatcgggtgagcatacccaacagcggacataaattcatcagcatccagcagactgctccagtcataagcactgacccacctatgcgtgtgaaagtgataaaactcacccagggttaatgcatacatgggaggccaggcgatacaacatcgcaagcccggagaactgatttccaacccgtctccgtaagctgcagacagaacgtccacatcaaaatccaaagtaggcacacatgatgacaaggcgaactcgtcgttgcagaccggtacgatctctgtttgaaacataaacacagaataaagtaaaatactttcacacaagactcgctctccgccctccgtttcaagtatcagtcaaaaatttcacacgaactacttactgagactcatgcacgattgataagtttccgacatgcccaacgtcgacatccgtccgaagcgcatggagatttttccaatcttctcataaccgtagtccgcaaaaagtctggcaaaccccacgcgcaaaaaagtaagtagacaatcgcccagcttaaccagcacgttgtctatccaatcgtaataatatatttttccagatttcccaatacaaagaataggtcttgtacatttagactcgtaatcatggtcattcaggtaacctaacactactactttttctactaagtcttcctgttcttttagatttgccaaacgacatgtccctgtccagacactgtcacgagtccctagggtcaaactcttaaaaaccggcatatccaatctaagatctcggccgacgttgagagacacgaaacgtcccacatcgtccaaactggcacaacgggcaagctcatcaaactcccgcaacatggcaatgtaatgtttcctcatagccttgatgcccaaaacgccttttctattcaacttcacatggacatttagagtatagggactccttaacacatcattattcattaagttttcaagcgattcgaatctggggccttcatacaagccatgacggtacacaggctccgcgcatgtgatgatattagtacccaggacgccgtatctcacaaattgctcaaaattatcacacacaaagtggagagtatccgtctctaaatcgtgcaagaaaattcttttagatcgaccaatcagaattggaacatctctgtaaggaatctgaatagtccccagtagacacagtttttccacaaaaccctgatagtgatcatccatatcttcaaacatcttttccgtatatccagctacatctttacgcggagtgaatctcagccagcagttccgaggccagataatagacagacaccagttcttatacctgccgacaaaattctcgatctgagagagatcggcagattcgcataaacggcacaattcggcaagagcgttctcgttcggaatattacctgaaatctccttcgcctcgaggtccatcttgaaaactccgaataacactagaagtgaaacaatgaggtatctgaaatataagacctggatacgagacgccgtcacatgacaggaaattgcaaaaaaacagagtggtgtgacaaactttattaaatttcagcctccgttttgactcacacgctttcctccgcatgtacaaataaatccgttccatcgaccatttcttgcgaatgttgaacaacaaacaccttcatttcctcggaattatgaaaatcttccttacatacatcagaagcgaaagtatataaacactcgcattccgaaagttttatacattgcgatttgacgtagctgcaatccgcattcaaacctcgcactccgtactttaagaaggaaacctccatcgttccggcttctgtattgcactcctcggatttcgatttagaaaacagctgtacgactgtcttccataactttctaacagccatatcggcagatccacttcagagaaaacgaactcgaaacaccactaaaaacagatggaaatagtcacatacaagacggtttcagcgagatctccgaccgtcacctggtcatcgggattcggacgagctatagcttcgattcaaaaacggaatcaagataatatcaggaaacccctacgcttctacaccggtctcctacactgccttataaaacaatatgagcattgcctcgtcccgccaaataaatcaatacgtttcgacaaagggaagattgaagtcgctgccctaattctagatctcggacaccaggtacttggtcgtcagatacacgtacgacaacgtatctacagctggactagcatcacactccctaaactctttacccccaaagaactttactttttaatcgcctctccagaagaagaaaacatcgcatttaatccaactataacaaagggaggttggatctcggggagtttttcgtatcccgttgattacagatcaaacttttcgctaaccggaatgtctgcgaacatattaatggtgccgttcgtgccgtacaaatacccactaaactatgctcgcttcatatcatcaatcgacctgatgatactaaacgaacaatttccggaacacgaatgcggagatatacagattttaaaacagagaaactacctctacctgggagtcatcaaaaatcttacgtggaaaaaaagcgtcaccggcacaggtcagacggctccacatagaatcctaaaagcttcgttcataggaagttggccggacacctccctacctgacagagtggcactgcgtttctttaataacactaggtttacaatacactgccacgaattctcgattaacattgaaaatctcggtctcgtcaaaaacaaagaaaaagtttttggaacactagccactgtatgctgcgagcaaatcccttctttactaacaacggaaaatctaccgaaatatttaatagttcagtttgaagtggtaacgcaaatcgaagagcccgaaccgctgttattttccagtaacccgaaattatattttacaggagacgtactaaacgcaacgatacaactgcaacacaacccaaattattacgagctacttgtacacgcaccatatgacatccatttctatccaagccgatgccacatagtaattctacctatccgatatttcacaaagcccgacaagcaaatcctcatatccggctaccagaacgaaggattcttcgaaacccaggtgatgctgtgggccccgggaacacctttgcacattacgctgcgttcattttctccaaatctgatcctgcctcaaagcacaaaaagacgtaatcgcaaagctgtctgagaatgggcattttattggcaacctgaaactccccagagaaaattttttacatcacgacgcgatcgctgactcgcctttggcttctatatccaaagactcagcgactcccggcccagagacggtgttttcatcagtttccccgtcttgacgtatcctcagaaccatctgttcaattatatcatctttttcttcaggtgtctcaaccttcattaattgcgcaggaacaaaactttcatcctgaccgacttttaaatctgaggtttccgtctcgcctaccttcactttttcaagagcgagatctatttctcgttctccgttacccggaagcttcaagtctaacgcgtccttaaatgacgcggaatctaactcgcgagacaaatcagcatccggtagcctaaacggagactgaacggaatcgagatcgttttgcaacctaaaatttttaaacatatcttgaggattactaacttcaagaattttttctacgttagcttcctccgattcgcgtcccgacttgttttctgtagccaactttaactcggtcccgcgctgattctgcaaaatgtcttcgatgcccttctcgcctaaactaatcagatttgtaaattgacttagaagattgttaactcgctgcccgagacccgcttgaatatattgttcatctccggcatttctagcatctcccattaaactacgtgatggctcttgtccgtttcgcgtcatttctttatcgtcattaaactttcccgacatttcttttttttttgcattgccgccagaatgcaagtccttgctatttcctttcccccctcttaatacgtcacgatcatttttcttatttaacccggcaaaaaaatcatttgcttgcttaatttttctcaacgccggggaattccgagcacccacagtttcagtcgcatcgccagaatctccggtcacctcgcgtgagtgcattatagctttatcatttctttccttagttaagcttttcggaatatctgactgcttctgtttcctaaaaccgtctttgcctctcaaatctttaatgagaaaaacgttacggggtgaaacgccggtctccgtactgtaagtcgtatgcttcgcttctgatcccgccacgtcggaattattcaacacgaagggtgtccctgtctgctcaggaacaaagcgatgcaccggatctaaaaagtccgcattcgccgctgtgtttctgctccacggtggcgaaacatttgatttattctgatgcagattgagattagcgaaaccatttaccacatcggtaataccgctactgggactcccgatcgaagttttatcctgtagtaaatccacaccgttcgtattcaattgcgcattaggtggaaatttaacattaaaatctaaaatccccgaagggccaattttataattaccgtgcgacttatctcgcagatccagattagtagaagtgaaagacgacaacggcagatccagattggtagaagtgaaagacgacggcgactcaactccggacattaaagagacagaggaagcaggcgttgtcgctttaacgttttcacccccgagtgttgcttcctttagtaaaattttttccccggcattatcaacgctatccaactctagaaatttaggttgtctctgcattcttaagaaactatccaaacttctggaattactttttttcagacgagccggatctaaagatgatttctttgtatctatagacatactaggtaaagtcaaatttgaatgtatatcgccgcgtaaagggacgaaatccattaaagaattaggcccaatctcagacatcgaaaatgctttcgacgcgctgtgtgattccagactacttttgataatatcataatcactggtgattattttcagaaaactctctactctttgaccagtcagaggagtctgcaaaaccctatgagaatatacaatattaaaattgtcgtgcctcctcaaatgacccgagagatgattttgcgtgattacaatttgactcatagcaaccttttctagctttgaccaggactgagttaacgctaaaaataacttaccgagataaattaatttattaatactcgttattaagtaaccgttttcgtcccaggggtcatttatgttatagacggtataccacagcatgtttttttcagcatcttgcaaattattttctatctcgctgctgtcttctgcagtaagatttacataaggagtatcgatcgcaacattgctaccccacttaataaagtttcctaaacgcagtaaagcgcgattaatatcactgaattgcgattcaaacttttctttgttcgtgaacatattttcaaaaattcctttattcagacctttggagtttaagtactcgtttacgacactttggagtttcgtgatgtcttgccatatagcattataatccggcttccttttagataagacgtagtgatacataagccataacactagtaggttatacaatgtttttaaatcgtctacatcgtctccctctctcacgacacaagaattagtcacatggggatgctctcgcaaatctacattatccagtctttccaaattgctgagaaaatctgtaagacgctcaactttgtctcgatctagccacgcaaacggaatcggatgtctttgcagatccatattttagaaaacaaactcaaaaacagaactgctcatttccgccaacattcaatgtttaatagtcttttttttacccacacagaaaactgacaagcgacgagatggacactgtcattgagctgtccaaacttctggtaagtcttcagacatcattgttaccgaatattttaatgtagcgtaacatgaaaataacattcaatatctttaatagcgcaatgaagagttcaaaggcaatgcttcctgtacctcgacacccacgctaaagacagcacgaatcatggagagcgcagttaccggaatcacgctcaccacatctatccccatgatcattatagtggttaccaccatgattctctaccacagagtcgcaaaacataacgctacttcattttacgtcatcacactctttgctagcgattttgtgctcatgtggtgtgtcttttttatgacagtgaacagaaagcaactgttctcattcaaccgttttttctgtcagttagtttacttcatctatcatgcagtctgttcatatagtataagcatgctagctataatcgcaactatcaggtacaaaaccttacaccggcgtaaaaagactgaaagtaaaacatctagcacggggcgaaacataggaattctcctactagcttcctcaatgtgcgcgattcctaccgctctctttgtgaagactaacggaatgaaaaaaacgggaaaatgcgtcgtttatatatcctcaaagaaagcttacgaactgtttctagcggtgaaaattgtcttcagcttcatttggggagtccttccaaccatggtattcagcttcttctacgttatattttgcaaagctttgcacgacgtcaccgagaaaaaatacaaaaagactctattttttattagaatccttctcctgtcatttttactcatacagatcccctatatagctatccttatatgtgaaatcgcatttctctacatgccgcagaacacctgcttttggttagcccgtgtagagatactgcagttaatcattcgattaatgccacaggtacattgtttctctaacccgttagtctacgcattcactggaggcgaactcagaaaccgatttaccgcctgttttcaatcattttttcccaaaacattatgtagtacacagaaacgcaaggattcagacgcatccgaacatgatcagaactcaaaatcaaaagcgtcagtggaaaaaaaccaacccctttaaacacgttttacaaatttttaactaataaatgctacccacatgaaatcacgtactatctttttctgtgttttatcttccatagagcatggcgcacgctaaaaaacgggtacgacgaaaacttttaacttcgacagacgaccccatattgtccaacacttttaccatgcgcccgacaagtaagattgcagacgctgaaatcatttcaagagaacatgattatatcgcaagcaaaacacagacggattcaaaaaaaatatcgcccctgtctgtgattttagacaaaactgtcctctttgaattttacggtataggagacaacaacgaaaaagctatcgtctaccctatcgatccagatttcttattatgtgactcggaacataattgcaccctatcacctttcttataaaaatttttttcatgatctcacgtcacagttttttttttcatatgtctcgcgttgatacatcccgtatgaaatatttaaggtggttgaaatcacaccaatggtcacacacgcgatggaagaaccaaagacattcaacattccaactttcgtcttagacgaaaattgtaacttcatacccgaagttctctcacgcgccaacgctaaatatatcaaagatgtactcatccaagactcctacaatacggtttgtctcgcaaacagctttattcccatgacgattcaaaccgcagagcaaattatggttatcatcacaaagtttaagttttcacgtgcacgagatctgttcgaaaaagtactccgcctcggcgtacatataaacagattttatgccggaaaaaaacaagtcaaacatatgattacaatgatgaaaagtcttttcgacaccgaagaagccatgcgacgtctcgacagagctcttatggggctgtttgtcgatgctcgtggtagttcatatatgcctctcatagccttgtccttgcacgaaaacggccttccagattccaaattcacaaaagccgtcaaattaataaacacaaccttaaactcctttcataatcgaccggacgcagatatcgaacagtatgcacaaaaattacgagcatacaattacctctataaaataccccattatactttgaaagaagctgttgacgtttattccgaaaatcttaaagatctctctattggagttaataaaaagcccacattactgtttacttcttcagacgacgggtatttatctcatatttttaacgacatgctattcttaacttctacttggaatatgatttataactgcaaagtacaaatcaggcgtttgaccacttggatcaaatacgaaatcaactccatagtcgaagattgcgtattggtgggattccaacttccagatctaaaggacacaatactagatctagcggcactcacatcaaatatgaatctcgtcgacccagataaagaccttttttctcactacaagctcatactggaaaaactttttgaaatctctattttcgcgactaaggcaaatatttgcattttaccaaccttcataaagagtcacctaatagagttcgaggatgtcttaaaaagaagcaatgatgatgaagacctcaattatctgcttctgaaatctaacgattctgatgatgaatacgacgaagacaaactaccaatacaagtcgatccaggcagagtagacaacgtgcttacagattctaacttttttaacgtaaccgcagataatgctttctcgtctatagcgatcatgccaatttcttatgataagatcatagatgtggaagaaaatgtaattcaagtcctagaagttgagatgcagagcctctcagcagttgtctacggagcagttgcaaacaaatacggcttaagcctaccacaagtcatcaaaaggttaaatcaaaatgaaggacgggcctcttctcgtgcatcctccagccacagtacttctaccatcccatactcccccccgcaaagcggtcgctccactccaacttctatcctaaggcaaagagcaccaatacgttccaacagcagatcatcatcggtctctttctcacaagacgacgataatcgtagtcattactctgacgaaacaaatatcagtgattattcatatcccatggcagatctagatttagaagacgaagaacccatggaggaccatccacactcccctcaatcagcatcatctaacaactccatgtctcgtcgaagccgagctctacaaaacgaacaaagaagacgtacgcccacaatggccccaccatctccggcaagaggacaaaataatgcccgcctcagacgcagaaccagacgctcaacggaaacgaacgacgaaaggttataatcacaaataattttattaactgtaaaaagtgctttatctagccaattcattgtacgataataaaagttccattgtttgattgatttccgtattcttgagcttgtggatcatctccaataaaatatcccgcgttaggtgtaaatcatcaacgtaagaaaaaaaacgaatagcattctgttcttcatcatcaccaagtctaaggtgactcttctctaaaaactaaaaaaaaaaacacaaaccatcaattttatccatccaatccaatataactttacattaaacactaaattaccaccagaaaagtatagtctagcaacctaatggaccaagcacctaattacaatttaatatatcttgaaatctactgtacaaaatcaaactcaccgcatatatcatattgaggaaaagctgtttttcttgtctactggttaacatatacaacaacacaattaacttcctgtaaaagaaaaacacattaatcggcatacattagcccgctcgcttccacgtatacttaaatcagtacccacctttttataggaatatggttgaactgagctacgatgaaacagtcgtttactttccggatgttcaatctaaaaaattgatcaatatcttcccatctttttaaaataaataacatttcaataactagggattttgtaaccgtcatactcaacgtaagagccggtaaaatatatctatacatagtagaaaagtccattttaaatagatatttaacgtatacgatttcgatttttgaaaacatattcgacagtgacattaatacaggcaaaggacacaattcacggcattcttgaagccgttgacgcttccacacatccatcttcgtcacagccaaagctctgttccgctcagcacgatagctctccgtattataaaaacagatactgaatcacacgctttaagaattaagaatcattggctacttgcccatcctttagaacatctcattcataacacatatacaatggtacaaaacaggatttaaaaactacaacgacaaatattatcatcggctaaaatttttattctgtatactaacatctccatacatcaagttaaatacaactcaaagtatgacgtatctatttactcgtcatcctcagatgataaatcataaatgtaattattcgagaatgtgggccctagagaagtatggggacacaacggcaaaatttcttggacggtgttaatgttcctatggaaaaatttatagcgacgatatcccctaacaatcccttgtcttaaaaaagattcaaaatcgtctgctattttaacacaagatccaattcccgttccgatcgtatcaataccataaattgcccccgataaatccatcatcacaaacatcgttttaggatacagtaatgtttttccaatgcttccgataacctgcccgtcatacggcatactctcgtagacatccgaaaagaaattccattccatcctactaggaaaatcttctttcctagtaagaaataaaacaaatactccatcgttattttccaagcaagacttcataatgtaatgcctcccactatttttataaacgatagtagcgaatttccataaattatcctgcgcatcaatcaacgattgaagaacatcatcaattttcgttagaaagcgaatgtccttttctcgatataccggatcatagcgacgcaatccgagaactgcaaatcgttccgtcgtttccgccaacagatacagtgtctcattcacaaaatcgagaccgtaaaatttttcgtcttctcccgcaaacaccaacgttttagttaggcacacatcacgagtctcctctccccagacagaaacatatccaagtagttgcaatctttccgggcagcaaagtaataacgaaccttgtttaaaaggaaaaataactttattttcacaacaaaaacgagaatgacacaccacagaactgacacgaaacactgatacttacacatttcttgcaactctgcggcagactttgtgggaaatggaattttacacagtgtcgaaatcaccaagcatcgacttttcggccaattaaactgtatagttaagccggtcttctgttctacgtatgtcgatagagaatcacgaaaaactgcaatttttatatcgtttagcttcatcagtgcaatatcataacgagttttaacagaatcgctggttcgttcgtctgccatatctacgttatggaaccgtcaactacccctttgaacccgaaactacaaataaaccagctcgcatttcttatccatcttttataccacacagagataaaaaactcaacttaatcaactaccatccaaaaacaagaaatgtcatagtgttgaactagaactaccatctcgtccacccatggaaaaaacaaagacaaccgaacaattccctgcgttaataatgattcttatgtatgtaaaataatacaatgtaaacaatactgattcaacaatatccttagtttattctcatagaactgatttcccgtaaaggaaacgaatgataaaaaccaccgttgcggaaaattcaaatactcgtcatatgcaaaaattccctaaaatcttatatataagaaagccacaaaccctcaaaacctcatacataccaaactttccgaagatcaaaaagagcagcaaatcgctgccaccattacaaccatgatcgccttaaacatcaactttttcttcatctattccaacggaaggaacaatccagagattacctctcaagatagacagatccataagcggcagccatcgaatgatactgacattgaaatggtaagaaatattaaaaacgtatatacaattttaccgatagaaacgcgatatttatttaagcactgttaaatcatttccataggcagacttcttacctgaaaactacagtagtcggatccgtaattcccatcgacaaaacaaaatagtaagtacttttatcgtttcgttatacactaatgcccaggagagctcagattttgactgatctgcacattacgaacaccccagggtatttacaccagtttgaaattttttataggtcccactaatccacattctaacgacactgggaatgaacgctatccgcgcttctctatcaaatacgcattgacgcaggtgagtaagtcttttcactaatccattttaaatccgacaaaaaaacgacaacattgactatatgtaattaatattttttatttcccgacaaaaaaacaacaacattgactataggtaattaatattttttatttccgcagatatgatttaatccaacgaccactacacattttactgtctacgaccaccttttccattgttttaatgtaattattttaataaacattaatatcctaaatctttcacaatatgtttccgcgtaatcattgacaaacagcatagcaataacagcatcgtaaatgcacccccggccaaaaagaacaacccagcagccgacattgaatacgtaatttcagagaaattctcgtaatcgcttgaaaaatccaaaaactctttgatctccttatatttataccaattactccatgcagacctccatgtatttcttaagaattttttcggcttcgtatcatttttgattaatgaaaaatatttcggatgcgcaacctttttcttgtaaatttcagacgacaactgaggacagatcttgctcagaaaatagatatccaaagacactctctcatttaaaatgttcaaagtgccattggcatcctgcccgtcacttatccatcgactcgcattgatttcagtgctggaattgagaacaatccgttccgttccataaaatagagtcatcacacctcctgcgctatgatcatccagccagcaatttacagtactcgataaattagcggcatttggaagcctttgagcgatcaaagctctaagcatcactcctctaaaataataattaataatcacacgcagaaaagccgttttttcagagatagatgtaatatttccaactctcatggctttaaagccatttgttaacatcgcaaggttgatcagatatgaagttttgacagaaacacagctagaattcccagctaacactccattcacataacaagtagagatgcatatagatctaagtttatgttcctgaattaagactattttttgctcgcatgtgaaattcgatgtaaagcagactcccattacgaagatataaactgacaaggactccatagttaacttcttcataacatttagtatttacaaatcgtttgcaatttcttccaaaaaatctgccgcgtctctgtggaatacaacaaaacaaataaatttgaaaatgtagaaaacaaacccattaaagacacggtaacgcaattcagtcatctataacccaccttcgtgcactcttgtaccagcaattgccacatgcatcaagcgaaaacatccaccatccctaaaattactgtttgtgtgcacgctctctccatccgtgaaacaattaaaagacctacctcagcacagctgccgattcctgaacagttttttctgggctcttaagccaatgaatgttcggtttgcattctgatggagtagcagtgatacaataaccttttaaaggtttttcttgcgccaaagacgcaccgccctgaacattttcacaacctacatcatcggttgccatagcaccgaacactgtcgtatcgtacaccgaatcgattcgaggattagagacatcaaaagtattttttgcggtcgttttgacttccgtttccaaaattgactgatggaccaaatttttaccgagaaacagagtttctgaagaattatccaccacgtctccggtttgggtggcagcgttacacatcacctcagaccggtctgtctgtgtatgcctcgagaacataatttttataccacgagtttcggtcagtccatagattgtgcaatgtcgagcggagttgtcttctcgacacgataaagacatacacaccttgccaccaacatctttattcgcagatggctgcagcaattcttccgtcggccgacaaaatgtatccttaacaccaaaagagtcacactgaattggtctcatggaagcacgagcatcttcttccacacaagcactgctctctaccttctgaaaccgtctaggcaatacacctgtcaagaaaattggagtatgtctcattctcgtaaaatatttttgaaattgatcaatgtattcatcgcgggacttctgtgcgataaaattactcaagatcgcgttctgacacgagaactccatggcagttgtccaaaaatctgaaaacgtaggtgacaaataaaataccacaccatcttcatatccaagcacttgaccagttgacgataacaaaaaaacaacctgtctctccggagccgcagacgcaccttcccattcctccgttacaccaaacatactcatcctaccctcaaaaggatacaacccgtttattaataaacttctcagctgacggtcagacaagatatcggaattgtcacaaatccgaactttaatacaagtgatatgttgaagaactattccggaagccatagcctcctgtacaactttctcaaatttcagagcgagccccgccgaagaaatcatcttatccttaaactgcaacatgcgcgccagttcatcaccggtgaatgccattacgatgtttttctcgttaatgactattgtaaccggccatccaaaaatgtaataactgcacaatcttagttaaatttatacgaaaaaaacacactgcaactccggaaatgggtgtggcataattttaaaagcaccttaagaaaaaaacagacactgttaaaaaaaaccaatttattaaaaaaatctctattcaaataacctcacagtcatggaaatattttccaaaggtaaaatttctaacttcacattgctaaaaatttcgtgagattttagactgtcgttctatatcaaacgaattatttccgcagacaaccgctatcgaattgtcacggaccttttgaacgctatggagttccatgtaatcatcagcttcgtaattgcagtattccacttccataatcaccataggcacttcatcatttctcctacgcctttttagcaccctatttggattcaatgaacatcccccagaaacaaaaaacagaatataccgcgttaacatatatacaaacatacacccagcagcaattggtatcacagtaaaaatccacagcagctgcaatttattaaatttttttctgtgcggtgctggaaaattatgacgtggaaacatgtcttcggattgcttcacgggattcacaaaacctttaaaactaaaagcatcctctcttgttaagagagctggggtaactaataatttatgcgtaatttcacatgaaaaattacgttgtgtcatgctcaaagctctactcaatgctctttcataagagtatagaagttgaccggcaatttcggttctaatgaaatcgtcagtcatatgatcatctgaaactgtctggttttgaatactccattgaatattcgttccaatgggccgatatcgccgagctgtacaaacgagcaaacctgtatctctcttgctgaaaacttgcggaggacgatgtctagagtccccgaaaacaaccttaccatagaaatttaagatgtcttctacacaaaaacgtcttgcataaaacgacaatacgtgcaaagaccgattttgtaaaaaactgctcaaatttataagatcgtgaacaaaaccacgattttcattaaacagatctatctgtacataggttgtattacccgctaaaaaaacgtagctgccagacaactgcgtattattgttaacgaagcaaaccaattcgcttacagaaaaatttcgaagagagacatactgaagcccagcgtgcagtctatgaaattcacgtatcaccacatgtcctaagaaacggtctacggtagaattttttccttcttccaagctccccgtaaggtcaaacaacgtctctccaacaaccgtatggttcagcaatgtcaaatcttcatagagcctctcgtaagcaaaaactatatcattatcaatgccaataacggtctgaagtttaccgattctttcagccagagtagtcttgatgtaaagtttagccggcaacgaagaaacgcattgaaataagcatgcgacaaagacagttatcatttttaaatttttaattcacgtcgaagaaaggtacggcctttgaagaaacaattaaccgccgtagtcaataacgtatcacaaaaaggccacatgtagtcaacactaacaaagataaagtatattatttccttcaatcctacaaaacaggaaatacccaggatacccacagaaaccgccaccgcacccatgaacataaggtttaatatgatagatgtcatctctgcaaatgataacatagccgaaccttcgtcataaatctgaatagacttttcaacattcttctccggaagcgtaacgataacattatcgccactctccttgttcgtgcacatgcagaaatatttatcccctacccatttatccaatggaataagtccccacgtcacatcgtcgcgaaataaagacgtatatgcaccggacgatctcatctttaccgttttccatgccatatcaaacgtcagtggcttctccgcaaagatttcgatctttcccagcctgctgacaccccaacctgaatattcacaaactgcaaactccccttctgcgcccagccacctagagaacgaacatttcaaatcatcagctctgaacaatctttctgaagaagatctgataaccggcataaaatttaggttcaacttctcgtcgtaaggcagagctatttgtctaaattcaccgtacaactcagataggattttaacgtcgttgttgcacgaagatatcaagtactgttgatatgtcgagagttcattccaaagacgtaacatcgttctgtcttcaccctgaaaattcttatctgcaatccaagagttattgttccgatcaagaaaaaaagcaacacgtagtacttgtttcttgagacttgcttcactcattctactcagtcgtatcgattttttattaacagagcattggacttgaatgctaataaatgtcatttttccatgaccacatttctgaacacgctttcttgcaagatgcatagttgcactactcacggtattaaacaatagtttatgtacgttattaaaaacctgaaaacatcgaaaaaccaaaaactttccgaaatcataatcaatttgactgttttccattcctccataaaacacttggttgttgaccgccgcactgccccacaactccactctaccgcttctttgatttctgtatgcagatatctctaacagcaactccccagctctaaccgcttcatcgttccctacgccaggggccggacaaatgggaggatagatttcaccccgagctaacgtcaagacgcataagaaaacaaggcagatcatcatgctgggttttccttctcttttgtgatcactagcgtccactaagtccagcgaggcgatctttaatataagatcgccgtcataccacaacgtcgaagggttacgcccacatattaaacaacggatccaaagcaaaccagcaagaacaaagaaccacaacagcaaaaaggtaaaccgagatacagtaataaacaaagcgctcacagcgggataaaaagcgtcgtctctcttttcggcagaatgctacagaaatgaagcaatcacccctctctgtagtttttctagcgtaatccaccacatacgttttagttctaattgactccatcaccgattgatttagtaattgtaactgcacaccgctcggaaaggaaacattacacttagtatcattgtccacgaacacaacaccaatatttttattgtatcgacataatatcttagaccccatggcggtctcgataacgcatcgagggttaaacaaaaaggctatatctctttcgaaataagcattaataggcacactagccatccgccaccaagcagttccgtttctctgagccatttttacaaaaatcaaccaatgccttaactccgtttcactgtgtgttgcgataaaaactgaattttcattgttaataatatgcaaagacgctatcaccgacacgtataatgcactcacccatactaaactacaaccctgaggcaccataatcactaataacaatctatgagaacctcatctgcaagtctttacatccctcctcatttgtacatccggttttttctcttcatcccaaaacaaagacctctgcttgtctttcttataccaattacacaaaatgactatcagaattacgaacgccccgataaaactaatcccgccgatccaaattactaatgaacttagaaaatctttaaaatactcctcatctccctcatgtgtatctgtaaactcaaggacttgaacagtatcagtttcccaaagagcctgaaccgtctttttcggtgtggatttcgtcgacaaaccctgaggcgtcttttcagacacatcggaaaatgtcgacgccgatattactgtgaaagacgtctcaatgttctgcgtctcatcacccttgaccgtcggaaacgaacttgtaacatttacattattgccaatggatcgatctgtggtttccacggctaacgtagaggtcaccataaaagactgatttaaatatgtctcagaatctatagatatttcggtaacatttttaccccacgtttcagaattcgccgaaaacgtggtttcggatttcccagttaaatagtcgctggatgtcgatacatccgtttccatgtttttagacgcaattgatgcaaattcagttgccgaaacttctgtagtcattaggttgagcattcgcacctcttcacaaagacacacgagtaaaaaagacaagaacaacatgtttttgcgattgcccaagtgcagcggttttttaatcacacccacaccaagatagcagaataaaaatctttagaacaatgttccgaattagtttttataatacaactcgacgaattcaaattaaaaatacaaatgtcgatcataaaaaaacacgattttgcattaaattcagatttcctcatacgttcaaattcgctatgttagtttaatagtcaatgcctgctattccttttaaccaatagagatttttcaatgttcatgtttccgctccacatcgcatcagcaaatgtttctaaaacaggtaattcatcgcctttgacgattcacatggaaaacgtaaagaacaaacacaataaacaaaatcattgcgatagccaagcccgtcaaaactaaaaaagaaaacgtctttcgtctattgttccacaaattccacgctgggcgagactgcggaggcggtatgcattcaacaaacgatgtatcattgataacgtgcggagaaacctgtccacacatgacgtccatcatcagcacctctgaataggacggcggcggcgtccgagggggatccatcctcttcacgacgaagattcacgttgaaatacaaggcgaagataaaatttctccaaacggacttaaattactaagaaaatcggagtaaacgagaaatgcgagcacgaatgcaactacgagaatgtatgttccttcccagaattcatcggcacctctaggaatggggaatagagttttgcttataagcaacatggtaggagaatacaacctaccctctttcaatacaattaacccccctgactagagacgtacatatctttaataatcctcgctctcggcgcgacctctgacagtgctcacggagaggacagaggacgtctctagaaaacatctcatccacctgcttaatatagtccgtatcttgcgtaaaccattgcgtatgcaaccgacgattctcattataacgcagacatccaatttttaaaaaatcggacatgttgcgagctatgaagagaaggctctcctcacggtcgacgcaaaaaagcataccgtggccgtcaaacactactacgagctccctccagtcaccgaaaaaattatgctgtacaataaacactacatctagtagactcgtctgcagtttccttcgccactgaatcaaatgtctactagaaaactcagtcatgctcagattgcaaaagcgaacaaaggtcttgtacggatatgttttcaaggtaaaaaaagcattctttctttcatttcggtaatgtaagagctcagaaaacgatttactgtgagcaatcatatccagcgccacagtactgtccagtgcataatcacacgtctcataaatcggataaaaaaaccgcaaaccattagaaaacaaatcgtgaaaagaagaagccacgtgataaagacttctgtcaaaaaaaccattatacacatagatgtgcccccgcgccccctgaaggacaatcggtcccctgcaggttctcgtttttgccttatgtataaccccaaccacaaccaattcgcctccgcaacacatataggtcttcgcccaattttgaacatcttcacgtgaaatttccgggatgttttctacactatgcagagtcaatcgataatcctcgggccagggtaaagctaacgtggcgccctggcgattttcgataaaatttaccagcaaatcgatgtctttgcttgaagacaaacccataacgatgaactgcccggctcagggcaaataaacacaaattgggaaaacattaatactgcaaaaaattttattggtgttcaccaaaacaggcacgataaattgtctaatcacacaccaaaatacatgcaacacacaactaaacaaaaaaaaccgttcaataaatcacccgcatagaaagatctgtctttcagatcgctgctcaaagtcaacataatcgaactaaacccgagacctacaaaggcttcaaagataattcgatataggcagacgttcatcataagtcccgataagatcgccaccaccgcgcacgcagcggctttgaatacgtttagtttaaaaaatacgttgttgaccacagtcaggaaaaaaagatggttagattttggcatactcaagaacatttttccgatccagagcatcgtaaataataacaaaaattcgaccgtaaactttacaaggcatttcaaatcaacttcacgaaacgacgttgacttcaaaatcggacgatatttttgcaaaccaagaaggaatccagacgatcgtatcatccatccatatctcacagtaatcggcaggagagacgcagccgttatcaagacagaataatcatcgaacatttgactcttaaaaaacaaagacaccatgattcccgtaaacacagctggggaataagacggcataatcatgacacaacgacttaaaatcattctcaacctcatctcggaaaatatcaagcagatcatgaccactgcagacaataatgatggcagtttcggcgccattaaagacagaaacacaatcttgaaatcacctatgggtttataaaagcgtggatcaaatcttttaaaagtcaacaaaaaggaaatcgcaacggttatcaaaacgccgatctgtccgaggggggacctcccctctgtcattctaaacgtatacaaccccggaataacggcacccttagcaagaccgagaataaaactatctgtcagacgacgcatctctgcctcttgggattgggattagagctgtagtcaaaatgcatggaatcgtcactttcgctatcttccttctcgttaaataagctagagcccgcagttccgtttttagcggggaccatgtagttggttattttatattgcatttcctgttttgatgccaacgcacttccgtcgtcgttcttatgactcctatccccttttccgtcatcttgtttacccattcgttcaaagcgagattcctctttgagctgttcctgagttaaaaaggcttccaccgtcaacaacgtgcttttggaagttaatatcaatttacagtccttagcggctaccgtacgtaaactacacgacgtcttgattacagcacacatacttaaagcctgctgtaaatttttggcagatagattaaatcgcatgttcttaacatcgtaaaatataaccttattgctgttcgaaaactccagttcattcatctctgtcacaaattttatagtcggaggattaacctgtactataatgtgcgccattaaagcgtcagatttaccagagcgtttagtcttagttacaggtgaaagccatttcaacacatcggaaacggtcgaatgatcaaggtcaatcctcaacggcgatctcccggtgtctcgcaccacttcttgtccgtgcacacagggaaccgacgcctgtgtacatgtatcggaagccgttaccaaaaccctcgtatacagatcactatcatgctgaatgtacatcttcgtaacctcaggattcgagatgatgttcataaaactttcaaaaagtggaatatgattattaatggttttcgttaaaaaacgatcagtatctgacaaaaacaaacattccgcctgaatagtcagcttttgcacgagatgatttttagcagactgaattattatcgacggctgcggcgtgaaagtcactgtagtattctcttttaacagttttgcaaacgctttaagcgatttattaatagttttccagcttttcatatgaaaagctagggtcggcggttctctcgtttctctatgttcccgatgatcacggtgatcacgatgatgatctcgactaccgcgctccatctctgtcaagaacgaagtcctagcaccaactcgcgccttatgtgctttaaaaaacaaatgaaatgaccaacacattatatactgtatttttttggcgccaacattttattacatcactacaaaatgttctttacgtgcataaccacaccatccgaacatttcccgatcaacggtaacggatttgataaatcaaggtgtttatacatctcagaattacacaaaaccttatacatagcgactttaaatccggctttatacagcaacggtagcaagagtctcaaactcacagtatcgttgaaataaaacacatttgcctgcccctgatctaaaaaaggcaatccactcttatacatctcaatcaaatcattcaaatgataactaaaaccatctttgaaaacggctaaatcatccaactccttgtccgtaaataggttcgtgtccacgtttaataccctatatcccacagtcttcaaatattgctgatgcttgttaaatctgttgagcaacagattgttatacacggggatatataacgattttaattccgacgaataaactgaagtgacatcatttaaaccgtcttttccaattacgactttgatatttgaccgccttaggattttattgtcttccatcggccagaacgattcagaagagttgatgatatcgaattctttctgcatggcagtaccggcggtgaaatgaatattgcgaactccgtgcatcagcacgtctttccttagcgttgtccacaattcctccgggagcgtgcattcgacattatcaaaatgatcaaagtataacatccccagtgcgtattttgacctgtcaaataaattacatggctctgctcctttcatgcaacaatccacactcgttcgaacacaagtataataaatgtgttcacatatcattcgatataatcgacgagcatctggatgtgcataggataacccgacagtcatgaaaacagaatgaagacccgtgacacagatacctagacttcgtccatcttcgattccctcacacagaaaatctttattttctacagcataatcaatcacagcattagcgaccaacaccatttttcgaacaacccgccttaattcattaaacataaaaaatttacactgcaaacgcacgaaatcaatctcctcagttagctcatcgcttacttcgtcacccaagaaatgtaccacattaagcaacattctcatacaagtgttaataccgtctctgacgggtaaaacatccaaaaaatcacccccgcaatacaaaggcacatgaggaatcatagaatattgatatacgttttttcggaaaataagtcccatcctgcccccttttaaacaaaggcaaattttttctataaaactagacatagtaattttcgcatgatctgttgtccgctcaaactccaaatattttgtcgagaaagttatctcgtcacactttcctaattcaaaagctatatttttatgaaaaagagaccactgcgcccttttcagctcgtacctatccatgaaaatcccaggaatgatcaagcaaaatgtgacccgagaagtctgaggcaaagcttcatacaagtccagccacattagtgcagacacatgccagacttccacatagactgtcaactgaaccgtcttatcggtatcacgttccaccacccgaatttgagacagcaatatctcaaaaatattcttggcttcctgttgataacgagtcaaattcatgcttatattagaaccgtttaacaaagccggaaaaagatgttcgccgtttactattgtaaaatccacaagggaatataaacatgtattgtaaatcgccacgtcaaaaaccgtgctattagccttttccacgaggcccaaatttgtcatacaggaaaacggtaaaacccatttttgagtaaaaagggaaaacgccagttcttcgaacatcacgtaaggattctcctgatatatctcccgcagataaccaattcttaacacgatctctgtcaaagtagcacacatacgaagatagatgcatggaatactctcttcgacaccgtttaaagaattggaaatttcttctaaaaagcgagatgcggccaaaactccgggcatatattggtttttccaactcacgcttactttatagagtacgctgcgaataaaatctcgatacttctttacaaagttcaatacatttggcataatcacattcgggcatgataaaattaaatcgtccggacaaaaatcgtaaaaaacactcgtcttcagataccatcttcctagcattcgatccactcgtggaacgcaatgtgtagctctcaaaacagaaattatggcatcccgcaaacaccaagcatctaaacctgagtcgagacgatcgattatcttagcgatgtcacgaacccgttcatacaaaacagaagcgcatgaatattgagaataacaaaaacgtttttgcgaagcttcgtaatgacaaacgcattttctgttgtagccataatctttattaatacgacgctcttttctcttcattttcaggcagaaggctcagaagctatacaaacacttttttctcagaaaggtcaacgaatatgttctctagctttatcactgacagggtaattccacgatactgcagaaaacccgatttaatgtcctccgtcgcgcaacgaccaatacgctgaacgcttccaaagtaactcagcgtggtattgctattaataagatagttcaagaacagaaaccgctccttttcgaaatactgtcgcaagatgtcaactatcagatcttcgttctgaaaactagtcagaactacgtagatcccatactggagctttgctaaaacctccttgtaaacatgaaccacgtaaacatactgggtggaatgctgccgcggttcccagtctggttctagtataatctcttttaataccgtgagcccgtaaatgttttctttgttaacgtcatagacatttccttgcatgacgcatgacaacagacaactgctgccgcaagaaactaagctcgtcacaccaaacaaagacactttgtcttccaggtacctacacgtattgatcatcgataacacgttatcaaccattgagtttgtatacatggcagttaaagcggttctcacacaagtagacacattgaatgcgttagaacaaaggaaaaacagacccacaaacagaattttagggttgtccacatcagtctcaaaacgatacatcaacattcccaaattttccagctccggtgccagtaattcacaaggagtgaaaacccttgccgctatacgtaaattctgcctgccggacaaaaactgtttcagaaatttcctttctttttctacaacattatttaaggttccctcatcgatagatatatattttctcttcttcacagcttccacagtatccacaatggcagctcgtgcactcgatttagagttcatccttagttcactcaaaaacagcacgtctccagaatcattactagccgctacggcaaaaatcgaacttttatccctggcagccgatagcgtaacacacaacagagtaatagcttttattaatcgactaaccccgaaaaaatatcactttgacctcatcagacagtatgcggtattctactttttaaactctacgaccttaacatcagaaaataaattgctctccgcagaacttttatacgaagaactcagccaaattccctcttcgagttcgtcgggcacagaacttgaaaacttaaataatgcagaggtcctttacgtgttcgatcgaatactcaattccattaaaatgctaaaaaatgagttatcgtccccaatcggcaagcttcgagcacaacccgccgccaatgacccaggtacagataaaacgataaaatactccaagattcagtcgatcatacaaaagataaacagctttacacacgaaaattcacttcttgccaactgccgcgccgtcgtagagctgatagacgatctatatcggaaactttactcatggtttctgcacgttctcactttcgaagacattcagtttccaggcgacacatttctagacaggctgttgaaaatggactactgttttacatattacccttcttcaaatcgccatctaatagatctgttcgaaaagacgttggacaatcaaacgttcacgaatctcgataaattttttgacacctcaggaaacagcccagaactactttatcaaaaaacgtttagcttgaaaatattttcaaaaaatctcacagcccaggacaatggattatatatctatccactacttaaaaccgacctgtccatcctcgacttcctcggaaccgaaaatattctcttccatcgaggcctcatctatcacatacttcatcaaaaaacaatccctcaagaacgggagaatgatctcaataaaatcaatcaatttttcgctactgtcatccagcaggttatcgaaacgaaaagctcatgcttacccgcatcgttatcccaactgctagatacaatttttcacttcaacagaatcggtttaaacatggaaacgtgcagaacctacatcgagatcctctcaaaccacatggcaacgccagacacccaacccataatcaatacattcaccattaacttaacccatattgttttcaccgcgcacgtgttttttatctgtatggaaaattttagcccaacattcatattctataataggaaaaaactcatactagaacaacagagagccattttgatcatcgaacgaaatgattattccacactctggaagcaaatatctgatcacatcgaatgtctctttaacgtctctctctccgaatccttttttaaagaatataccaaaggaggaaacgaagatcaaaaacagtttctatacaaaaacctattcgaaaaatggggtaacgtatttttccctttcacgtactcggtatccacctcaaacaactctacggcacaccatattacaacccttgagctaagagacatctgcaaagaggtctatcagagcgattccccggacgcatatgaatctttacttccctacagcactcatccatctttcaaaacattattcgttaaaatctacgttatacctatggtttcacacattaccaatcttacctttgataaattacaatctgattgcagactcttaactctaatccacgcctgcaaactcctactcccctcgcaacatctactactacactacatggcgtggctatatgccttctccataaacgtggaccatatagatctaggcactttcaccgtaataaagtccgtaatctttaaaatcgctgaccacataaacgtgatgacgcatacgatctactccccggagacaaaccttctcgtaagcattctactaaacgcgtataccaactacctccaaaaatacgtaaacccttggatcaaacaaaccataacggcaaacttctccctgatacagacgtacataactttcacgaaacaatgcgccagcatcttggcgaccaaatgcaacataaacttagacaatctatttatctacataactatcggaacagacaaaattgtcaccacttcgttttgctccttcatcgctacatgcaggaatttagtacgtcaacacgaagaattcgaaaaatcactacaaacgatccaaatttccgaaatcacactcacggggatgctacgaaacataatcacgagcgtctcctcctccaaagagctgctaaccaacgaagcactacaaaaattcatcgacactgtccaacgcatctcccaacacgtaaacgaaacataccattctatttccgtgaacctcgaaaaatgtaaaacctcaaacgacatcctaatcgaatccctgaagaagatcatctacatagttgatgtactcagctccaatgcaatcctaaacacgtcgttagcttccagatgtctggaagccgccaacctcgcggtttcgaacaattctttcacaatactcgaaattaaaaaggacgcagttgccgttttcaagccttttataacacaactatttgaaagcatgaaacccaccacaagtttacataagaaattgatgtctacccaaaaactaaccaccgaccacattccatttctcgatacatttgacgataggtacaacctggtcagacacgtcgaacgacaattaaactggtacgctgcacatgctgaggcagcacagcaagatcttattactcctcttaaattttaacggtcgcgttctaacccatgaaaatcattaccagtagcacaaaccaaaatgactctaaatacggaccgagagccggaaaacaatgcatgtcgaacagcttttcatttctccataccgtttacttaaacggaattaacaattctctcaatgcgggtactatagacgccataatggaagaaggctatcacttagacacggccggcaccttagccctaatgttaaataactcagattcgcaagactacagactccccaccgagatccccaagaggatccattctagatacggtgtcacacagcatgaactctcacggccatttaacggaaccctagacacacaaaaaattgacaatgaggtatatctcggactcatagatttcatactgtatggcaaaagcaagaatggtcctacttttgcagtcatcacgatcggcgtgctatcgcgagcacttttttttcttaacaatactctctacttattcgactctcaccctactgaacgagaagccacagcagccatctacatctgtcaaaacattgaagaagtttatgaactgctcaccacccacggcaccgaaggcttctactacgacgccagcctcatttttttcatagaaacctccaatttgtcgctctctagtcacgacgccgagcttctcatcctaaaaacttataaagaccccgacatagcgattgcgctagataaattttcttccacggaaatccatgagataaaaaaaacagatgatatcggatcgcaacaggacctcgttgcggataaaacgacagatctagaacacgcgccccataaaagaaagaaaaactctcatagtctagaactagaactaaatgacaaaaagaaaaaagataccgcatccttgacatattacgcaacagaagttgacctcattccgagtttttatgaactacgatcacaatttcaatctttatttcacgatctcaaatcttttcctataatgaaatctaatttcaactggaccatatacttacaagattctcctattaatcctaatcagcccttcgcaacaccctttctctggaacagagttttccacttattgtgtcaaattatcgacgtgtttgtaggcgtcggatccacaaatgacgattctagcaaacaacaacaacaaactattttcataaattatttattgcctttcaaggacttttccgaagtattcaacgaggcgttggcagcttgtcaagaaaacaatctggacatcatcttcatttacaataattacctgtgcaaaaccacgacctttcgaacactcgagagaatcttactaagtaaatttctggcaatagttgataatgatcacaaaaaacattatgaatgggtcaaatcgtggaccacgcaaatgttccaaggaatgccaaaaaaactagatgacatagaaaattatctaaaagcctacgtggaccataaccctgtgaaacactttcatgaattcatttgtctgaataaggcagaaaaatacaaagtagctgttctgctaaacgaaaaacgaaaagagattcaagaggctattgaacgagaaaagaacagtttcgcacaactctctaattttattgacaaacttggcgaaactcccgcacttcctatagaatcagaaaacgtgcacaaagttcacacgagcgacatcactgaaggcatcgttccgcgtttcataaccgaatcgattgaactaccaaacatctccacgctaaacaacacccaacaaatatccctagataaacaactcaatgaaaaactcaccaacaccattcacacgctcacaaacaaattcaccaaaatcgtacaagataactataacaatatcgctgccggtttcatgcccgttaccgaactgaattgcctatttgcctacctagtaaacctttattttaacattgaagttttaaaacacagtggcctaaacattaacactgtgttgcttcaagaggtggaaaaactgtatgacaacacgcaatttctacgcttcggaacttctcacttcaatataaacaacctttcaaactttaccctatctatcagaaaaatgttcgtagatttctataacagccagaaaccctcggacagagcttccgaaatcctagccgcaatcgaatccatcctagcggatcccagcaaaaacaagacagtcgtaaatatagaaatgatcaaatcgcaacttgaagaactggggaaaatggaaatctccaccaccgaaaacaaacagacagctgcaatcacaaaacaaatcctaggggaccaagagttaacccccatttacgatttcctgcaccacctctctgcttataacctacctaatactacaaccgtaaaaaatttacacctccatttcatcttagaacaacgaccagatatcgctatgactctacacgataaaatacaatccatacttgacatatatgtagacgacatgctcaatgacataacggtccctgaacagacgttttcaaccgttctatttcttgtagatctcttcccaaacagcaccgaaaaaacagcactgttcgaatccgttctcacgctacggcaattagcaaagaaatgcgctaacttaaaaactctagatgaattcgacgatctggcccaattcatcacgacgaatagcgaacaacttcaaaacatgatgagacagcattttggaaaaaaaataccaacgctgatgggacatatcaaatttctctactctcaaaaaataatcaccactgaagagaaaaactggatacagagagcaaaaacggtcgtcatcacatctcccgaagaactgacagccttcttagccactgcacccactaaacacgccttacaaacttgcaaacctgacctcgataaagcactacaacgacatatggaagagcaaatgaaacaaactgccgagaacgacaaaaaacacatactcacaatcagaagcaccctcgaaaaaagactgaccgacatcttacttattctaaaggatggtcaattttcgtctctggaaacaatgcatttgaatcttttagaaacctttctgaaacaactgcaagataacaatgtcatcattcactttacccatgcactactgccagtgttaaaagacatagaaacgaccatcagcaagatcatctccgacgttattgaaaagatattaatcaaaactcctctaaaccccgaacagatgtccaaggaagaacaaaaatatacccctttactcagtttcttatccaagttcaaaaaaacaacattctgcacagaagatgtaaaaacagaaatcgaacaagtacaaaagagtatcacgttcctcaagaaaattgctacctccaccaataaacatactagactcagccactccatctacggacaagaattaaacctctacgaagagcgcattacagagctgagaaaagagacgaacaaaatgaaagaacagctctccaaagaatacgcattagctgaaaaaaaaattcttctctcgtcacaagatgcaaaaactgacaaaatttatctagttctaaatacgcacacgctgaaagaaataaaaaacactcaattcaaagaaacagcattcgctaaagctctcacggtggaagtcaacaataaagaaaatcaactccaggaattgttaaaccactttaacgcacacctaaaggcgaaaatggatcagaaccatataacaaaactttcattcgatacgaaatggacagccttcgtttcagattccaggctctacatcccagacttcattaacatcaaactgcaagactttatttctgatccctttaaagttataagtcagctaatgaacaaagcaaccaacgagatgccttacattcaagcagagataactctcaaatggttaacaaaattaatacacgacatcaacaaattctgcctgtcagctataagcgaattcggtaaagaagcaatcccatttaattacgcagccctacgagatttggagtaccagatcaacaccaaatacgtagaaattgaaaacaaagtcatttgcaacgaaacggtcgaaaacacgaaaaacattccaaaactgactaagctcttgaagcagttagatcctaaacgcgttgccggtgggcaggaacagtatcaaactctcatgaacaagattctcacttccgaaacttctatgcaacagacctacgaaaaagaacaactcaaaaaagaatactttgagatcgtcaataatgtcgccagcttcaagttagcattcaactttcctcagcaactacaaaatgtggaacggctaatagagaagttcaaatcgctgcccaaaagccagccatttgaaaaatttccacaggaaaatgatctactttctgactcactcaacacagaaaattatattaacggtctgcgcgcactcctcaacttcataacggcagcgcaaaactacatccagaacacacttctgaaacagtgggcggtctttcagcaacaaaatttcatcccgattgattactcagtagcgaatgtcaaacctatttcggatttatatgcccgcctcaggattgaacgggaacgtcaagtgttctaccaagtaaactccgtctttggaactcacctaatcgttgacgatacaggagttccgctgcaattccataacatctttaacaacgccatagtaaagtttttctccctgaactacaagcagattaatgtaccagaagacaccccccgcttggtatctagccaatataaactcctgtccgtatgtaaatctttcataatgatactacaacagttctgggagaatataatcaccctggacctaggcccttacctcagagacggtacacaaaattttaaaagagaactcataccgatcgtgaacttgaaattatttatatactgcataacacaagcctggacagcctctgaagacagtactgtttccacagcgttcgaattacccatcaagcaattcacacttttgatactatgctcacatcctgaatacctctacggctgcctcagtcattccacagatctggttataaattcattagccaaaagcatagacaaaaacagtctctataacacattcgtcgttagccacaaccctcccgagaagcccatgcatttaatgagaaatatatgtatcgacacccagctatggcaacccgccaaacttatgaaagataccttccaacaaacattttttacacaactgtgccccaaaaacgaaaagttttttatctatctcactgcctttttaattctaccctacaaatttatgaactatatctggattcaatacaaaccggccatttttacccaaagatcttatcaaaacctaattaaggacttatgctccgaatacgtacaccaaaataagatcactacgtcctcggtaactccccacgaaccagacacaataaaatccggagaaaggattacctcaaaaatcaccgtacacaaagcacaaaacacaccgacactcactcgcctgcaggctcaggaatatgtcttcgactacattctttactccttcttgacagggtatgaaatgacattcgccatgtacatcgatatcatcgaaaaaacatacctgctttgcatgagacacctggaaaacgtactccacgataaagacttccaatctgtcctcagagcacgcacattcgacatcgactacatcctgaaacagtcatggactaaaaacatagtcgaacattcactcttttcagtacagctcgataaaatcgtctcctacctcaaccacacaaacagagcgacacccaatattcctttgatattatttaattatgacaacgaagttgtcaacgtttatctaccgccgatgtccaccaatccaaaaaaagtcgccttttacatcaaaaatcctttccactttcccgtgcaagaatacgaagcgacaaatttaatttccttccatctctacccaaaaacaacagatattttaaaccaacttccgcccaacaatactgagtctactcgcccgggtaaacaaacctctgaaactttaaccaacaaaaacctctccgaaccaaagtttaaaaagcctgccgttactggacttatgcccaagagccaatcgatcatcctatccactgataccaacgtaccggaaaccagtccagacgtaaaagctaacacggccagcgcagcaataaaagatgtcactctagctcgagaaaaaatcaacgagttctccgaatcgataaatacaactatttcaaaattaaaatctatgtatctgtaacattcaacacacagtcatactccttttataaatgtttattatccaaacatacgaaataaatgaagctttcatcaatcactccctgtttttgtgttcagtctatgcagcgccagcattcttatcaaatcgagtcggaacgccgttttatccacgttaccgccgttctgcttagcatattttggcaaaaaaaccccaagaacgggatgactggccatattaggctgcagccccaaaacaccggtaagcatctgctgctttttcttttcttcttctttttttgaagaacctgaaatctgagtgatctgattcgacaaatcatcactacgtatggtcgtcatttcaaatacacctcacgttttgggaaatctggcaaccttgacagatattaacacagtcttccagatctaagcaagtctctctaaacgaatgctgacagcgctgacactgaaaatcagaaccgtgtgaaacaagccgtaacaacttcttgacggtcacgttgtagagatgcacagtagaataacaggatctacacgaacaaggaacaataacatcgaacttcacattgtcatttaaaatagtgcaagcagaatttgttccgatcaccgccttccatgaaacggttttcaccttcatccccaatacacaatgctcagacatctcatatatccgctcgaacaccaactgctgactcccacacagcgaacaatacattacatccgtgtgcatgctgtatatcaaatttttctcctgcttgtctctaaaatagaacatggagctcagcgaaaagccctgcggcgaacacagcttttcttttccggagtttaagcagtgaccacattttgcgcaaataacgcaaatgtaactctcttcgagtataaagcgagaacatttagtcttacaatagcacataacgggtaacgaaataacactggtagctaagccatcctttaaggacgtcgccaacgcaaaggttagaatctttggaaaatcaccccgttcaggtttgctcggcaccataggtactagattattatgctccactggaataagatatctgtctgcactaaaacagaagttttccaccaaagcctttgccatagtaaacatgaaattccccgccggagatttcaaagcatactttcgcaacatagagggaaatgacaaaacgtgctctctctgcctatatcgcaacatcaccgtctcggtctgctcatagtcacgtaaacagaatagcctcatacacggtaagttcacgtgcgtcggaatcggaagcaacaactgttgctcgaacaggaacatgtgcaactcattgatttcggaaaacgagggcatctccaacaacttattaagcttgtacgggggataaaccctgaatctagtctcgacgtccacccatttgattgttttaagtttataaagagacaacaattcgagaactttacactgccgatacacgaaatacagataggcgagcaaaacaaaaagaccctttgtcataaccattttgttaaaaagtcgcttagtgattaatcgcgtctccggcctgcaacgcaaccaaattgcgaaaaactcattataaaatttttccgttacttccttattcaagaattttttatttgtcaaaaacattgtaagaacacactttcctggcacacaggcctcacccatcacaaacaattgcaaatgcgtgtacgacccatgtttacacaacggagccagaagctggcgtaggagtttttttaagtagaacataacaaaaatacaaggctaaaagaaaacagatgccgacaagcgcaaaccgacaatgtctttcacttagtctccaaaacttcacaccggacagtaatgacttctctttttcatagaactgctttatactctcctgtgatgtcacaaccgcagaagctttatttacaactttcccgctactttcgaatcgccccttttccaaaacatgtgaagaccttcttctcaaaccttgacaaaacctatttgattcgagatgctgtttccccatagaacacttctttaagaaaattgccttcaaaagcgaaatgtattcagattcgttttcaggtccgaacgccacaaactcaacaacgtaagtgtcgtctcgattacgcctgattatacatttcgtgaacactgcaaaagttgaaggcttcatagccactatgtcgctcatgcggacagtcaaacattcattaacacgcaggatgttgcattctctcacagcatgatgaccttctactttaaccggggcatgcaaatagcaagacatcgacacagctccacctgtgttcttgaacacaaatctgggttcctgcttagttacatgttcccaaagacttagcagatattctagattataagcgtagtctaacttgagaatgatatcacacaaaggaaacttcgggttcttcgacaatagattccgctcagttatcctatagtcatgagaccccaactttaagatacgacaggtcgcactcagtagttcatcgtacatcttttctttgagtacgttagccatttcacctatttaaaagctattccgtatttaaatattcttgatgttctaatattccatttacatttaacagctttgacaatatcgaagtaagaagtaccattttttgagccatgacctctctatgcacgcaatcgacatccccgtgaacgtatctagcaaaagcaacgtgtctatatccaacactaagaaaattcagtcgcgcctccaaagaaggaagcatcatttcatataatcgtggcaacattggataaaacacgacctcaaactcccttccctgctcacagactcgctcatacaaaagttcaagattcgtcttttcaggtgaggaatccatcatgtacaaaggatgggactcagaagcgttgcctatacaatctgagatactaaacgagattctgttatattgctacctcactcctcaaccaccgatcccttccgagacgacaacagccaccagccccacaaacatagaaaacgaaatatccaatttagacaactctgaaaacctagaggaattaaagcaactatccgtcgcattaaatatagacagacgatgcaacatctgctccattgtaaatctgtgcctcaaacaaaacaaatcatggatctacgactacagtctactgtgctacaaatgcaactacgcgccaaaaactccactgtctcttctgatcgtttccacagaatttttaatgttaatacgggaacgatttccaaacatcaatttcgacggtctttttctaaacaacattgtctccatctttgactttcacgttcatttttttattcacagatgcttcgcaaatacagtcaacgatcacatccaaagcgaaaacataaccctgaatcacatggcaataatccgatcgaccctgctaaaagaagacactataccgcacatcaaaataaaaaaatttctaaccaaaaaaatgaacccgaaaaaaacacaaagctccgaactgaataaaaaactcacagtgcccatgaagactcgcttcacgacactcttattctatatgtggtctggcacgaacgtcttcgaccgagttcccttcacggacctaactatccgcaaacatcgcttcatcaaaaacctgtattccaataaaaccgacatcgaactcacagctggtcccattcttttggcacagattccattttctatcaccaaaaacaaaacaaccagcgtctgtctcctatgtgaactgatggcagcttccaaacaagattacctatttttaaaatatctacatcagagcatcatggactactgtcaaaacaacctaaagatgatagatagagttcagttcgtcatcgccgatatcttcgagaagacaaaaatacacacgcacgtcaaaaatctttccgactacagcaaggcgatattcgataacgaattctcattctcagatgataacttcactctcgatacccacgtttacctgatactccgccagactggaacagtgggagtctataagcacttcttttgtgatcccctgtgtctagcaaactgtaaaaccatcaacccggaggttctcttcaacactacagacgccggagaaatccaagacttgaaagtcaccatatgctaccgtaacgaatatttaagcatcgtcgaaaaacatgtttggctagcgatacatcttttcaaagcttttcagattattaaaccaaaccataaaaataaaactcaaattacagagtttctcaaagacttcactaacctattagcacttcaccacttcgatatcgtcgatcccattttcaccgtcaactactacgtttgaagaatgactgtacacaagagccgtattcgacgatcgcgaagcctgtccgtgacacacagaatacaaaaacgacctgatcacagagaaaaaacaaagctttacttacaactgaaacttcacgatctacacaccgtcttcaacctgtttccagaatacgaacagaaatttctagcgatcataaaactgccaattaccggtaaagaacccatcgacgtcccattcagtctcagcaatcaccaccaacacacctgcctagaattctccccctacgctaacgaacaaatctccaaaagcgcctgcctacactgcgaatccgtctccgttccaacctcctcagatgcaatggtcgcccacttgaaccaagtcaacaacgtcatgcaaaacagactttacttctacggttttcgaaaggacatggagctcatacgaatgtccgccaaacaacccactatctttcaaatcttttatattgtccacaacacgatcaacaacatattccctatcatgttcgaaagaaaacaaaagctcggaatgcacatagttttccagtctcgcactctgcacattccttgtgaatgcattaaacaaatagtagcggtatcctcgggctacaacgtttatctagatatactacaagaaagtgtaatcctaactgtcctctgcgaaacactagataccaatactaatatccacatcgacatagggatgcttcaaaaaaaactcgaagaaatggacatcccaaacgaaataagcgacagactcgaaaaatacaaaggacacctaataggtttccattaaaccactttattgttaacatgtacaaacgacaaaacctaaatacattcacattacctctgcaatagcagaaaatgtttcatccaaatacactttcataggaagtaaatacaatagtaacttctctttttttatatcggttttcggaaaaatgggtgagatcgcattagtcacagccttgataatctgatcgaaatacttctccgcatgtataggaatcttgtgttctatcacatagttgggatcttctgctaattcatagttatgcgtctgtttattgccaatagatggtgctattaacacgtacataattcggtcacctacattcggaatttcttcctttctctgcgccaaccttctaatgacgctaaggtgagccagattcggttgcttatatgcagccatttctttggaaagcacagaggacaacattaaatgtctcacgtctgcccgattctgaaaaagctcctcccgcgcttcgcacagacgacgcaaaattttatgaatacccacaggcactccttgttcacgcaactgtgtctgtgtcatgtgagaaaactccacagcagcagtctgaacctcttcatcaaagaacaacaagtccacgatatctttcaccacacccttcacaaaatcgcaagaagtctttctcaccagatctacccccttaaaaattaaaagcgaatcatcctgtctaccaatgtatctttttttacaaatcaaaattagcggacataaaatcttttcaaactcgagcttgataggcgacttgaacagacgatctgtgatatgtttggcgatcatcggcgcaatccttcgcagagactgattaaccatatttctgacagacataaagatgctatccgtatcaccataaattacctccacttccaaatcaccagtaaaatctgatgacgttaaaccaaattcctcgcaaaaaaattgctcggactgcatcttggaattaacataatccaccgtggaacaaagcatctctcttccaagacacgttacagaagcagcaatcgcaacacacggcaataacccgtgcgccgctcccgtgacaccgtacaccgagttacatgttgttttcagagcgagctgctttttatccagaagaagtttcatcatcggatccgaacagttctgcatctccgccttcacttctcgtctcttggccagccagtcctttagtagactcccaagcacagactcacggatacaaggcttcacaaaccgatgagtctcatcccccaacttcacggttaagatgtcactctctgacaatccagctatctgtcgttcatccaaaactaaagtactataacacagattatgcgccatcataatgctcggatacaaactttgaaaatcaaacaccacggtaggcacagcataataacccgtcttaggctccaaaacggtagcccctttgtaacctatcccttgtctattgtgcgaagacaccatactcggaagaatcatattacggcgttttgcttccgtaagaatgcagggaaatatcttcttctgctgaccctcgaacaccacacatctagccgtgacgtgtgccaatctggcgacctcggcaacctcaaaatgataattaatctgtttaaagagacgcacaactaagacagagtcctgtagacaatacttaccgacaacagccctgccactgggtccactaataaatttctttggtatttccttgtacgataactgctccttttcttgctggagacagatcttagcaatagtatccagtttgtaattctgcgccgttatcttactagaatagacgggatacatatccagatacaacactccggaagtaaacaccttggtttgcgcctgaaggaaccccttcctgtactgttcgtgagggacagagattccaatctttccattcttcagtttcgaaaaacaaccaatatcataatggtaaatcttatccatccttatacacaaatattttaaatcaaaattattaatattataaccggtaataaactccggagactcaatccttaaaaatatgaaaaaacccaaaagtaattcaaactctgacgcaaattcatatatatgcacgccgtcaattttttcacatgttcccagagtaaacagatgtcgctcatcacggtcaccttccgtatcgaaactaattacagaaatctgaataactatatcacctaaattttcggcatccgggaaattcccattttgacccaaacactctatgtcgaaagaccagcatccatataaaggccaattaacgtcttccagagaaactaaatcagagacatgacaattaatttccacctcaagattactcccttttcccatatcttgaggaatatatttttttacattataccatccgaaactcaaaaaaccattatcgacgaagaaacgagtcaaaacatctacgtcgatttcataaactacgaatccctcattctgcagaatctttccaatacgttgagatacataaaaatttccaaaactcactttaaacagattaacgacagtgttggcattgtacccatacaacgacaacttatcagccggctcaatgacaaaagaacacgacattttaacctcgccggttaacatcaaattgtttatagtagccttcaggcttcttccgtcgacgcattcgcagtagaaatattgctcctgtccaaacacgttcacgcagatcttctcaccgtcctcagttctcccaaacattctaatcactgtccccgaaggaatcacaaaatgtctatactgaaaaggaagattctcgatcgaatccgtaaacattaacgtttctacagcatcatatatgtgaaacttcatcctcatatgatcataatccttggaccgagctatgtccaaactcggccaggtcatttctttgctcagtaaatactgtcggtctcgataaaacatacgcggttcagagtcacaaacatcctttattaatcccgccgcaccatcatgcattataccgcgaggaagtatacgaatgtaactcgatctgctttttttctttaagcgattcgcttccaaatatggattaaaaaacgacaccgaatccatcacgcttcttctacatttacactcttataacctctatacctgatcctgtctatcaaactaggttttgaggcatgagactcagaagacgaaggttttcttctgtaggactcgtctaaggactttatggccttgagcatttttaaagcatcttcttgtgaatattcatcgtcacttacttgcccactgacgtcagccataccctcctccttttccgaaaccgcaacagatgtgcccccgtcaacatccttaacactaggtgtcttgacgacagtggtccccgtaacactggacacagtagtcaccggattggtggcataaggaaacatcatgtcaataggcttactaagcacatgtctttgtctaacgaaaaccacaattattatcacaacaactactatcgctaaaatcaacatgagaccacccccgaatggattttttagaaaagacaccactccacccacaatatccccaagcgctcctgccgtaacacttataaccgagcccaatccagtgcctatagccccaagcccttgtaaaaaagaattaatcccattaacatacgaaggtgtattcgtagcaattttagcttctatagtatatagtgcgctcttatatgagttatattcacgaagaatattctctagatcgaaaacgtttgctctactcaattcgtccggcgaatataaatcgagtactttaaaatcggcattttcaagaggatcgatttttagtctaataaaagcatccaatacctcaatgtcttctatgggcgtcgaattcgtatgcgtataatcggtatacacgtgcgcatgatttccagataaaaagatctttgtactaggtatttcacattcctctgtcctatgatcacccaacagaatttcattatctaaccctagctggccagggacaacctcaggcgtcgagttcacaaaactaaacgtcaccaagggccgattataacacatcgtttcactccttactccctttgcatcgacgacccgcatactcttatgaagctgaacggatgactgattaacctctatgcatttcgagatagctaacacgtcaccatgcaactgtgcagatatcggacgaccgtaaacctcagacacgatactcgacggactaatcttactaagttcgtgcaacatcgttatcgttcgcttttgatcgagacaccaagattctgccaaattccccaatgcatcattgatataatctttcaaagtatcataaagatactgtaattgcacataaagaatatcatgtctagacttaacatcccccacatctcgcctcctacgtattttttccgaaccctgctcaagaaacataagagatttttgcacaagaggttgccaaatcaaaatcaaatctcccgtagtcttaaaaatttgataactaccattcatgctatatgtatcattataatctgacatatagacttcattaattattttttcaaattcattcttaatacacgtttgtttcggatcggtaagatttaaggactccttgggggcgacgaaagcggctgtcaactccttagagataaagtgataggtctcattcgtctccgctcgaagcccgtgagtcaccgtggtccagtgctttagcatacacaccgattcattctcttccttgatttcccaagaaaacaaagtatccgctttctcgagaaaagcgattttcctcactaacgtagtggccccattcataccattcattagatcttctatcatagtatagttttccaagattgtcaatttttctaacggctctgcaaaatgtttaccgtttgaaccgttgaagaacggagacccttccacgatttcgccagtcgtcaaagcaaagtaactaaacgggtatttcgccttagccgtagcctccgtcacaatacaattgagagacgttgatgtagaatatagccacaaaggaccccttgcaaagtagggttctttcgtagtgataaatcttttattagttatagatttgaaattcagaggaaataaatttagagtattgtttttattattatcctcatgaaaggcactaaacaccgtaccatcgggtcgtttcatcgctacggcggaataacactgcgcatgagaattaactaaatttgcttcgtacaccggcatggccaaacccatcaccgtccgatccagaaaataaaccacacccacatcacggtaactactttggaacgtcaactcttttttatacgttctcactggaaaagtgtaggtctcgatatttgttttgtaaatgatgaaaaaaccctccgacatctttgcattagacttatacggcgagcacgaaatatctctgtcgaaccgcattaaatccgtgcctttggcaatcgaacaaatccgaaaaggatatttgtgattatagcccgctctgatataatgatccggatcacaatatatcattaaaacactattcatcaaaaagacagccaggaataatactgccatcttgctcattttccctaacgagatctagtagattaggcgttcgaacagagtaacttactccttccggcacgtctacagtctctctcgacaactgagcttgcaaatcacaatataacagcgaatacacgtctttaaactttgtcatgccaccaccagtgtgaaataataaaggagactcgtgattaaatgtcaaaacgacatttccactcaaatccccctcctcatctatacgcacaatttttaatcgctttccaaaaacatcattatatagtgcaacagaaagtgttaactctctgataaaattccacatttttttctgcatgtcatttacatcagttacaccggaaaagttaaaaaattcattgtattcgcacaccatccacacactaggatgaatagtgccctctatgcatctagctaaatcttccttcatatgcggtaacatctccgcgtggtcgcaaccatacgccattgagatgttcgccggaagtggataggcagatttatgaaaatccgataacggacccgttaacaatgtgtacataatctcacttaaatccggcaagagctccaaagggagcttcttcggcatcagattgtttttaatataaagatgttcatcgtatgtacagctatctacacggaaagagccatccaagtacatttttctgagaacgaaaccgttcataatcttcgataaggcctcaaaaataaaattcccatacacattcacactcactaccttatttatgagtgattcttgctctcgaatacatgccatcaccctattataaccagattcagaaaccttttgaaaatacgcctttttccgggccaagacttcctgctgaagattatgagtttgaagcatgcaattgatcgtgttaagccttcccggtgtttctgtcgtctgtggatcccgaatgtcatgcaagagactcttaattttatgttgaacctcatcttcctcagccaatcttttaaatattggactttcttcgagatttttaatgctcaggccagtgacaagatctatcagcctcgaaggagacacataaatggagccaacgtacaagcgctcgtcatgcgttaacaaattttcactcaaagccaagaagtcttcagacacttcaccgtaaagataaagactgacatcattctgtaattgcttatacaacgtatgacaactatttaactgctgaagcgtaatagcgacatttctcactatcgtttccgatattttagaccaatacgtaaactcacttaaagaatatatcacgtcaggtaccttgctaaaaatattatactttttcagagttttctcagcatcactaacatgcaacgactcggctgaacgctgctgcttaaaaatctttttgatttcagtcgcaacagactgaacagtcccatagttcaaaatagcctcccctaagtctttctctatcgtctcaatgtttttttcaatattaaaaaaagctttttgttcggtcaaatgattacaaaacttcccatgtaatcttcttcgaagtgattttccttggtttggagtcaaagtcaattcttcgtaacacttcatgcaagtcttagtttcgagataactctccggtttcgcaaccatacatgcaccacacatgatagttaacaagtctataatttttccgcaaatctgcaacccttcttggggcaaaagtaaagcatatacggagttgatcttactgattaattgttctatatcatttagcgtagataattgcacgataaactcaacaccgttattcaatgaaatgtttattgacaaggtctcagcacaacgcctcaaacacaacaccttttcaaaatatttttttctatcctggtctaccataaagctttccaacgctgcatccaaaagaagcacctgttcatacatagcttttagcagtacctgcatataaaccgtcaaagctgacgcacaaagaagattttgttctttgataccttcaaaaaaagtttgatataaatgcagaatcacaatcccattctttttaaaatttgccatatcagacaatactattacaggatcacaaaactttaaacattcaaggtccaaagcacattcattaagcctagcgcacaacacacacagagattgtaacgaattcatactccgattataatcggtttttcttagtcatcggctcatctgtttcggtttccgtttcatcacattttaatacaccgtttccttgatcgtcctcctccgctagaatttcagaaaagtcatagaccggagcatcgtttgaagacaccgtctcgaataccgactgcagattagttattgaaaagtctttcacattcatatcaactaagtgattcaatttaagcattatggatgccgctaaggcttccctaccatccacaaaaaaaagcatatcatccatagtcggcttgtcttccctatccctcatcacctcagctattattaataattctggatcaatatcgttagttaaattctcaacaatgctgagaaccttgcccttaactacttccgtatcaaacataattgcctcacgccgaacctttttcactataacttctgaaaactttgtagcaataatcgttttctgtctcataaatctaaaatcctgcaatgcagaagaggtagggtttaagttcctatccacgccacttccgcctatccaacctaactggccaaactgaaaatattccctattagccaaactcacaaatttctctaatgtcaaaccaaatgtaaccaaagatcgacttgtgaaaattgtaccaaaattgggttctttggacagtgacgcaatcacaggattcggaacgccatccaaaactaactttttaacataaactaaatattcctgaatagaagaaaatttaggctgcttgtctaacaccacaggaaacaacacaggattctgcgtaaccagcttagatgtaagaccatgtaaactagtcaagtagtcatgaaaacctaaagccgacaaaaatttgttatgaaaataacaatctataaaagttgagagacactctggctgtatgtcgataatatctatctcatcataggtattcgtaatactgaatgcaaatttaataaaagttttaacttcttcggggttaccaatatctaaagttttcggaacattgttgagcagaaaacgttgccatagctctaagcacgaaatcttcacattcggaaacaatttatcatgatatttaaataaaagaaaggagatacagccagacaagggattcttcttatgtttcacgttttttttaaaataaggattgttgtgtgctgtcttactagacttgttgaacggtctattttttattctaaaatctcgaagacattgcatagacaaacggcaaagtttcgcctgaatcgtagttttcacatatttacccgatttatatagatcgcaatctaagatttgctccatatcaacatttgaagcgactttaactgttctcgtattcagaaaaccctttttgagatagctgctgtgaaacgttccgtataatgactggtactgctgaacgagccatttagaaattgaattaccggtacaaggtctatcgacaacatgacctgaagccactatcaatgcgaggttctgcaaaaccgtcaaaatgaccttataatatgaaaacgtcaaaaaaggagaaaaggcagttgcataaggggtcgtatctacattaaatgactgtagacaattttctatctgttctctaggcgtttgtgtccttctcatttcaacaatgcatctagaaacacattcctcgatacactgtgttaatccgtgaattatagaaacaaaatcttttttacttcgaacattgaaagtatcttcgcctgttacaggatcaatcagagaattttttttacagtaatcgaagatctgagatacgaatttacccctgtccagtgagagcgtgttttgttgatcttttccaatctctttgagctcgctgacaggcttcctgccaaaagagcctaatatatcaacctcggcataataccgagaaaacatgctcataacaagtggttcctttttaacattctttggtattgccggtaaacgagtaccgacccgcaccatggcagttccaatacacgattgacaacatttcccatcacagaattcacataaattcgccgaacaatttaccagatgattgtaaatctcagtatgcgcattacccgcgttataaacgctcatacgatttaaattccacaccacaaaagaaagcagctgtggagaagtcgcacaggcataagccaagtgattagctgaaaatttgtcatctttgcctgatgtcgaatcacatttgataatttttctattatcgttatacacatcgtcactcaaagacgacaacgcattacaaaaagacaaagatctcagcagtaattcctgagtcatcaccgaattaaacgcttgtttcacgtttggtataaatgccaattttgagcaatataagatagaatttggggcaaagatcaaaacagcaagatgactagacagatgtaactttaaattcgtgagctgcgccatgcgttcagcgtgtgtctctgagtttcttatgattggccagtcattaaaattcattatctgactagggtcatataccgaatccagatattcggctacatgactaaacgataattctgtcacaacggaatcaaccaacatcaaaaaatctttctcgaccgctgaaattttctgtccggagatacccagataagttttatggggtgctaatttgacagtttgctccccatcctgtgtaaattgtttcaggccagcatcgattaattccttagtattagaaaatcgtaatgttgtaccccatgatgtaaaaacataataaaaaagcgtttcacttaacgcaggcagaaaaaatcctcgttcctgaataaattctgtacaggaagataaagaaatcgtttcttcagtttcaaataaagttgcggaatatagaggaattttcacacacgaatactccccaacttgtacttgaatttgttcttcaacacaaggaattaacagaccagcgaacaacaactctttgaaaccgtttccacacgcaacatgacaaataacagaatctgcatctttgccgacagcagaacaaagagctttgatatcgattactttgcgtgctgtaggcacctcaaacgattgcaagtgaaatttttgtctggtttgctcacataatcgaataagatcaccatgatcttcggccataccaactaactgctcagttccatgaaaaaaaaaacacacgggcataaaagacgtaattttagttagaattgtgcctccaaaattagtgataggtgttttaaccgtggtcgagaaatcgttttctacggtcaaattcattaacaacggcgaaataactataggagaatttctctccattaacgataaaacagataaaacatccaaaagttctttatcttttgggaaaacatagatccaagcagcagtagaaacgggagcagaaactaccgtttcgttttcatcagccatctttgtggatttgatcacagaaacagagataatggggttttgtggtgaaatccttatatattatgtttgacgtaacataacacgcgtcatcaaacataagagtaaaccacaagttgaattataccgttttctatatgaggtttacggtcaaaagaaaaacgatttttttatgcaaatattttccacgcagatgatatgacacgccccttaatttaaatttatgcaaatcgtcgtccacctcaggtacaatagtatattatatatatattattttaataaacttattgaggacgggagaacgagggcgtggcgtttacgtcatagcctaattatgcattctcagaacaggatttaagaaggctgcgagcggccgactgttcagagggacgctggggtacggcttgatacgtttgattgaaaatgattcttcgtgtgctattttctgcaaaaaaattaattcgccggcgacagtaaacttttcagcggaatttcaaaaattaattccatatgtaatttaagcattttaaaacgtataactcacaacgtgaaaacatatttacgaatacagtagttttcgtgatatttttcgaaattaaaaaattttaaatcgggtaaatgataaagcatattattagattcttcacgttaacaaagcaagtttttttgaggttttcggtataattttaacatttacttccacatgtaatttaagcattttaaaacgtataactcacaacgtgaaaacatttacgaatacagtagttttagtgatgttttttcgaaattcaaaaagtttaaatcgggtaaatgataaagcatattattagattacacatgtaatttaagcattttaaaacgtagaattcacaaagtgacaaaacattaaatacagtagttttcacggtattttttgaaattaaattttaaatcgggtacatgataaagcatgctgttaaattcacgtttttagggcaagttctgcgaggtttgctttgtgattatcagtgaatgtattcagcgtttcaattttagattatggttcggtaaaaatataggtctttgtaaaatcatttgatttagcttttatatgtattagattgtgaggtgtttgaagtcgaagtcgttaatatcgtatttagaattaaggaattggtatttaggatactttttccgtatttttagtcgcgatgaggttatgacgatggtttcgtttgcatagtttaaacggtaaattcaaaatccgaaaaaagttcaaagagtttcatggatagactaaaacaggctttcaagttttagctagtatttattttgaatttcacttagggtacataaagctttggcatcaaaatttttttgattttagaaagaagtagttaagagtgtgacggcaaaaagtttgtacaaaatgtaagaatttgtttacggtaagatagttattctgagtcagaagaacatgcgtttaagttagtttcacaggtgtcagcttcatagtctaaatctaagtccatttcaacactcgattcactttcatgtttagagttgacgttttcattaatgttaataatcacaatttcttcttgttttgcttgattgaagtttagttctctaggatttggtattttgttgtcggtttccattgattcttctatgagaatttcggtagttgtttttgtcgttgttaggattgaagtgtccggtttttcgacacaaactttggacttgactttaggcgtaccgtggtttttatgtgaacgatgagaggtctgaggtaggtcgtgatttgttgaatagctacatgaaggttccgtgtcgacctttggacaagtaaaagaaagatttcggtattcttcaggaaaatttggaaatagcttaaactttggtgcgtctttggcgaaataagtgcaaaaaaatagactcggtttccaaggagccatgattcgttcgattctattctgacagctgacatcatcgcatttatggttactgaattgttttccgatgagtctgctcatcagaccgcattcgtatcgctcggctacccgtcctgtgtcgaaatcgcggatgaattgcggcttctttgtttgtatgatttgctctttgatttgtcgtagtattcgagcaaacgtaacaacgatggacatggcttgttgaattgggtgtctaaacgagtctggagtttgttgttgtacttcaagctcggagtttggcatctctcgatctagtacaggtttaccgcagagttgcctgagttttcggtattcgatgtcaccgtgtccgttgtcgttaaaaacacaggttaactttgccatgttgagtttgttgaaaaattcgaatttcatgacggtgatggtatacatgaataagtcttgtgggttgaccggcaggttgtgaagatcgtgaaatttaaaataactgcaggcttcttctactgtagcaactgtaaaagcaagacaaggtgagttggtcagggagaatatccggtcgcccatcagttgctgattttcttctcgtgtgagcgagtctagacattgtcggtagcgaagcagcaggtcggtttccagtatatcattagtcaggagacaaattcgttcgtgagtctgtgggaatctgtctcggatgcgttgttttggatcacgggcgtctccgttgtaaggtctcaggccgagagattttagcgaaaagtttgtgtcggcaaaggggactgttggaagattaggcagaaaggtgatcgcattgttttgagcgcgtttttcttgttgtttctcttcgatgatggtcttcagctgttctaactctgtcagacttagtgcgtctagtctggattcacagtgtttcagaggtgcgagttttcctcgaaaatttttggcgaaatggctgatgaacttgctggtttgtctatgcgtggaacgttttatcgttctaaaggcggtttgtctatgataatcatgatgtgagcgttttactccacgaggatacatgtttgcttataatagatgaaatgacataaattggtctctttatatgttttttgagatgcttttcgttggcgcttttttgcggttaagttttgcgaaaaaaggaaggacggtgttactgatgttttaatctccggaaatgctaggatatggcgcgatttagttagcgtgtgcgttggagtcaaatggtaaagactaaaagaaggtctgggtttagaggtagtaagttagtttttcaattgctccaaggcgatggaacaatgtacttgtttgctgttggactggcatttagtagcaaagcacgtgctccacaagatgagaattaaccgatttccgtcggctttgagttgtatgtaaactaggacgttatctcgatttcctctatgttgtctgttcaggcagctaaaatccgaaactcttccaaattgtgtttttttgatctggaggttctttgaatctattttaataaaagttacttgtgaaaactgttgcgctatcctagtctcgtaatgagtaattagttgcgttttaatgattggccatcctattaatctgataaacgataaaagggagtcatccgctgatgttgcattgttgttaaaaccatgcgtgtttaggtacttggtgattagagtctctgtagctatgttaactttgttccacagttgtctggattttaaatccatgaaacttaggttttctttagggcagcctttatccgttatgttatagattaattcttcgatgggagccttcttagtaccgtgatgtagaaggttgtttaaatccatttgcatctgaataaatgtcttgcaagaatttcggtaaccttctgggacgataaatatgggagttagacgtccatgtagcattttccctttgtccatgtctgtcttgtacatataacctattctgatgcagtgacctgtgtggtaaatgccgatgtcgaaacattccccgggaaatgttatggaattgaggatctgactaagctcctgatctaagcacataacgtgatttaaaatcttggataattgttttaatggttctccaccggcaatcgctgtgccattaggtaatgggattgatattctaagaccgatctttttccgacaaacacagaattgtttgatttcggttggatcttcagtatagtctagtgtgtcgttagttgtgtcgcactgggttttgaagaagaagatgggatgtgtgtctgtgtcgatgcttggaaaaatttttttccaggcgttgatgagggtaagtcttatgaggcgacacatcgagaaaaatgtttcctccgtaatagttgctgtatcttgcagcggaagatccaagtctcctatgtaatttgtgactggtatgcgttcgttgaatatttcgtgtcgtgtggtatagaattgtttttcgacgtcgtcgcagagaaaatgtgtgtcttgcagccagatggcgcgagttagagcttcatcagagatatattcgtcggggagatactgtaagatgcggttaaatcccatgttttcgtaccaatcctcagagtttccgaagcaaaaaatatttttatgtaaaagctgcaccctgaatacaggaaagggacggtgataatctttgtgtaggtgttgtcttctgtagatgcgcttatcttgtatctgaacgtatctatcggaagcggagatttctaataatccttgtaatcctggttttactggagaaaaaagaccttctccgtttttattacatttcgctatggcacgcgttatttgttcggaagttaatgcttggatggtcttctttttagagaccagagcatactcgtattctgtaacgtttagatttggattttttaatctttttatgtctatgtatgttttaaagtaacaatccgcattaaagtattgcttcatgatacacagtaaattttcgtgcagggaatttccaagaatgtggagatttctctgacattgttgccctattggtaaattagagtcgtaagaagtgagattgcagtaattgacgaattttgttgtctctagggccgtgttgtaagcgatatatatgtaatggacacggaatgtgttggttagatgtgaactctttctaaatagattgatttgagtgtctagatgtttaaattcttccttatcgcgaagatttttttgtctggcgtacgttgagaagtctgcaaatagttttctaaattttgattttaaagtgatgtttataaattcggacatggaagaatacgtgaacaccatgtttccggtgttttccgtgaagcattgaacataatttttggtagtcgtgatggtactcttttgttcctcgaacaaatagtaaaacattgttaataaaagcataccttctgtttgcccgtaggtcgataaaaaccaaaagggggaagtgggcaataggaatttaccggtgagatatttgataatgagcgatttgtggaaataggccatgtatttaaattcgacgtcctctctttcttttccagtttgagataatatcatgtcgacatataacgattcggtttctttgtcgttgaggctgttggcgacatcttcagcctttatcggacttgcagtttgtatgtagtggctgagatttaatttttcggcatggcagacaaataccgtgtcgattcgctttgaatttttgcatttttgagtttgaaggcagaaactaacgttatttgatggtttatatttaacaataatcggaaagattaaatgttcactgggacttctacataggatactaaaaattacgttggcggcatcgtattcagtcgcaaacactacgatggtcattgtgtagagctctgttgattacagatgaatttagctttaaatgtccttggggtattggggtgttatgggaaattgttttcgacgattatctttgtttggacagccgactcaggcaaagtatgaaatgttgtgctcttccgacgatttagagaccgaagagctgacgttttttctggatatgacgtataaagattttggagtttatcagaatgatattataagtcatcaaaaagacacggaaactatgaaaactctgttaggcttattaccaatgtacaaaaaaactaagctcaggcatacggttatggagcgttgtttatctaattgtcctaaccatgttaaagatgcgctctgtgtagagcttatgaaagctgaaaaaatattacaaacgatggatgtcgtttttatgaaaactttaattggcgaattttccatgtgcaccgaaaatcttaatcagttgcttaacaaattcgctacagatcagtcaacacttagcgatgtcgagaaaataaacagtctcatagagattgatggtgaaaacagcaaacgtcttttagtcgagttggatccgattctccatgaggagacgggattatatcaagcgctgccaaatgttgtgacggaagctccaagtgaaaaggttaaatcgatacgcgttgagtctgaaggtgagagtgtatagttaagcgttattggaggcggcataatgaaacaagaaagaggaattggcgtctagtacctgtagccggtttattgcacgttcaggcattaaactgaggcaaaaatgtccgcaagtaaaaattatcctggcgatgcagatgcctgtagggatgtagatagttttgcgtgtggagttgaagatctttatggagggaattgtatctttgttccagatgtaggtttcgatcaataagccgagtttggcaatttcttttgagggaatcatgagagccttcagttcatcggcgcaaacgtacatggcgtcgaagtattgtatcgtatagctgttcggtttagctataaattctctggatgcttttagatggaaaattgcaaattcggggggagacagattgatcatctcccatggttccgggatgtagcaagggagaaagttgattgagaattccacatctcctgggagaagcattagagagtgctcggataagttcattagaaaaactgaaatgtcggtttcgtcggttattatttcagtgacgcattcgcagaatacgtcgttgctgtggccagtaataactccgaagaaaccatctgggatgtacagggaaatatctagttttacgattcgaacttgatcgtgcggcacccatatgagttctctatttacgagtgtgattttgttggtgtccataaaaacgtccattttactattcctgtgatggcttactaaaatagatggttcttccgaaatacaagtgtccgtatttgcatttctttttgcgcggtgccttgggtagaaagttactgggttgccgcgtttcctttcatagttaacacaatcggtttctctttgcttctcttttttgcaggtcttcgacactgttccattttgcggaatacctagaagcgggattgggcgttgataagaggttagttcgttttctagaaattttttaaatgatttctcatttacagccggccacacgtcgtgcgttttgtcttcagatatgtctgtagtccaaagttcattgatgtccacatttcgaaagacgaaaaattcaatgtatctcgagctcgtttgtctctgtagggtaatcgtttcggagatcttttctgaaattgcgctgtacatttttccaggtgacagagagctgtctgctgttaatcacgtcgacgcgaagactagttgaaaataacgcttaagatgagttgtaagaaaagcgcaaggcaaagcttatatgtcagtctctgcctcttttacattcttgtttttgcggccgctacggaagtggacttttattctccagagtgccattcgcatacctatgagatcgtcttgaattcattttcttcgatctggcttttgataaatctttttttattgttatgttctttcgcgattttcttgaaatactggtgttataagacttttgcttcagagacggtgaagggttattagatcgcgtgagacttctattttaattataaatgtagcatacgacaaataaaagcatttttgttgtgattggatcttgttttattatcttcaatagattttataacgacaaaagacaaaactcatttcaaaattgagtttttattgaagactgaagatgagcagctttggcaaacgtatgcagttatgtgctgtgttgtttaaatcgcgtcgttcgttgtatgtgtgatgcgttgcattttgggttgagtatgctttggtttcagtagtgaggttatctggatggttgtgtgagtttttatcggtgatgtggtagtcgttgtttccaggtagagttgcgttagcctcccgactttttgtagaacttttttaaacctctgtagatcgtcccgtgattgtttgggggtagatgttagtcgtttgtgacgagatgttagcttttgttagtttggctgattgagttctattgctagtcgttagctgtgttgtgatatgatctgtccaccttagacttgtattcgttaatggttccttaggcgttgttgttagtaagtttgaccaggttatgatgttaggctttgaagatgtcgttaagaacgtttcagcggtgaaggaccgttgaggtgtagttgatttttccgatgtgtgagcgttaagaattggtgttatttgtgctatttctgtgtggtttatctgttcgtgagtggacgctgacattctagtatgctttacctctttagtgacttcagtgattgagtatgatgaattactagatggtaaagcgttgttagttatgtgtacttcagttttggcagttacattcgacggtagtttttgttttggagtgacagacaacgtctgaatggtaggtagctcgtttgaggatttcaaggttgtcctctggaatttgtcggtcatgttttgtacttctgtgttgtgactcatgtatgtgcgtaccgtgttttgccaagtggtaaactttaaaatcggagtggtgtgttcggcgtcggtgaattttgttgtactctgctgtgatttgctcttaagataaatagagttttttggtgaagaataggtattgccgttaatttccttgattcctattgttgtgaaggtggtgctttcgatcttttgggttgcgtttgttgttgctgtagcgctctcaagggttttgggaattctgattgtggtattttcaaaatttgttggttttggtggactttttgggttttcggtgttttgttcggttttaatagtggcgttaagacggattgtaagagttggaatgtcggttggggtgtacatgggtcgaggaaaatctgaacgtttaactatttttttgatgctttccgttgtttgcgttgttatagtgggtgtgttcggtgtaacttttatggtgtctgtatgcagttttgtagagttttttgttacggggggaggtgctggggttggtatgttggtactagggatatgtggtgatgtgagagacgctgacgtcgatgatggtgtagtagttagtatcgaatcaaagtttacgatggctcgtccaaaggaagtggtaacatttataggttttggcgactgtttgaaatattgatcatttgaagggacgcatgatgttgtgttatagagcaagaagtaaacaaagctggtgtaattaaagaagttttttgacgtgaaggaagtcaatgaccgtgtcagattcgagttggaaaatttgctcattgccatccgcaaggattcttcggttagttttatgtcaaataactgtgctcccagaattttaaatggtagtaactctacgcatggcggatctgcggtatatgtagatagtgtggcaaacagaagataaaatagagaaaaactgctagcgatgatagatttgtttgcagtcgtcgaggatagcactattttgatttctgtccgcggtaaattctgtaatggagacaagctaaccgcagacttgcattgtgaatctcgaatgtcccaagagaaaacgttagttaaaatttgagtgaagcagtcgagggatagatttgtctgacaaaaacttgtatataagtttcggaggtcgtaaaaatgttctctttgttcgtcgctccaattgtggcggttgacggttttgaaagcttctaagggatcagacgtgtattttattagattaacggagtgcatgactatcgcgaaaaggcccagaaaaaggccgagtcgcgagatgtgaagcatgtcgggtgagttgaccacaatgaatttgtacaagtagaatgtgtgactaaaatagtatttgctttttttataggattggacgatgacctccaaatgcatgctgtgttggaccgcgattacgaatgccctggctattttaatgttattactagtaatttaccgggcgataatcggatttaatggcgatatttatacgagcacgttgtcggcgtttagctgtatacggacaaattcatctaatacctaacataaataaaacgtttattcaacacaatctgataagtctatataatccgaataaagcaattattgcgatcagaatataaatgataaccaatatgatagacacttggtctatatcgattccgacttcagacatctcaaaaacagagccgtttttggctaacaaaagatagtgcgtcctggtgttgggaacaagtaaattgttgttgggatctgtcaatgtttttagttcgtctatgttttttatgtaaatgtattgtaagggaccgtcgatatcatcatattccatgactacgctctgacagaactcgcatgtttgagatgagatgtttcgtagcacaagcagatcttgtcctgcatatttatagttggttgaaacgcaggtggaattgagaggtatggctgtgattattatactcgtagccacaattgtcgttgtaattgttaggctcactcctttaatcacgtaagagggagaaattacaaatgtcacattcggcagagtcagagaagctgctggttcacttggggagagacactgaatagccgctactctctccatatttggcggtctgtatacggatagcatctccatcatgtctgatcgataacggtcaagggaagcgtacgtgagaactgtttttagaaaagaatttgtcacatctctgcgtacgggggaggcacaaggcgaataaatattttctagattcggtgccctgtcagctgtaagcatgcgggcccatgaaactatttctacggggttacacaggtttccaattagtagttgcatgtgcctctgcatgcgttcatcggtagggatgatattcgctatttcggctagcatgaatagagtttccctatcggaaaatgtcagattagtaaaaaacatgtgtttttcatagatgttttgtagagtgttggcaatgtcagtccacttgtacttggaaatcgttacattggattcgtacgctgtcgctaagtacgtgagcagcgtagatacggaaatggatttgtttttggttatgtagctatagtccgagggctcgtattttaaaaattccttcatttttgggtattgtaacgtaccttccgatacgttcacacatcggttgacaaatgagtcgatggacaggagattttcgtgtgtctttaacactcttaacacgggcattggtcctgtgttttttgtgctatatgagaaatgtacgataccgtaaagaaacatcatctgcggtatgccggcatagttgggttttttacagtctcctcttaatagggtttggattcctaggttattaaatttgagtagtagagcttctacttcatctacgtcattcaacgtttcgtctacgaatgtcgcatctgatatgaaacggtattgtacatctattacgtctttttcgactatcaatagtaaatcgtctgtcaatgtctgtttgaatatgaatgaacttttcttataaggggctttaaagtttatgctggtggtgtttccgtacatcatagtcagatctcccgcgggattctggatgtacagtatcataaagtccggagtaaagaaatgggtatagatgtcttcgcccacatagcgcgtaattttagcgcatctgacttggactggaaatattagttccttgagagaattaggcagcttacaggaaacgttgtcgtattgcatctgtcgaacttctacgaccctgacgtaataaattccctgtgaagggtacatgtttaaggaatacacaacctgcggttggatagagcgatctaagttaaattgtttgaccgaaggtacaggagaaagtcttaaaatatcgttcattggcggctcataaaaacgtgtaacgcgtttttcataatttgttaacgattctgtcgtgttgatggcatcaaacaggtggtatgtgatatcggagccgagtaagcatttagggacttgatatatccgagtgtcgttttttgtataaaagttaaatgttataaagccggggcgaacgattggattttcaaagtttccatttctacaatggctcgagttcgatatgttcaacggtctccaaccgtaacagggagtcaacaggacaaagacccagagtcggaggagcatagttgttcttcatcgatgaagtgtgaaacggttctgctattctttgaaagttgaacactttttgatctttccatattaaatagattacaaaaatgatgtgtaatggaactcggaattgtttctaaattctccgtgtcttttttttcccgtgaaataacatgtctctgacaggtttgcctgatatccggaaaaaaattggacagtttcaccacttgaggatatataaacagatcttatctttacaaggaaattttgcgcgactaaattattttttaggagacgtgtttccggctaatttgcgatcggcatctgtctcggtgtttttcgaggtgcgtctagggccgcgcattccggattgtatcgtcttgctaaagagtgtagatgccaaagatgagtttgcttttcattgttattttttcgagtttaagacgactttggggaagtcgacgatgcagtctgtgcatcacaactgcattcaccaggcgcaatatttgcaaggtttgagacagttgcaacagtctatttcgttcttggatcaatatttaatcgcagacgaggtttcgtggaacgttgttcccgtaatctgttttttcaggcagtggggactcaagttagatttttttaaaaagttttcggggaagaccaagcggttgtcattttcgtttatacgtgatttgttcgccaggtctcaggatggcgcagtgcaatctcttttatcaatacccaattacaccaattttagaagggcatgtcagaaacatactgatttgtacagaaaaagatgtcgaaaagctccaaagtcagtcctcactaagacttcgggagaaaatagatcaagggcatcgcgacaagttgctaagaatgcgcctaaaaaccgaattagacgcactgcaaaaaaagatgcaaaaagacagtgacgttttgaattctcatttgaaagcgatagaggatgctttgctgtttacgaatgatggggaggtaaacgtcgaaacgaaagctgatgcgcaactgataccgaaatctcctgagaagctggaaaaattcaatcaggtcgctataaccccactcgacccctttataagatttacagacgattttagaggagaaatgatcaatacatttttcaataatgcccagatgtggaattttacgttcgggtcttggttctataagctcaagagggttttttacaatgagcccggtttaagaagggctttaaaacttactaatgtggattctctgactatttcaaaagagttactagcagttaccgtcaatgcgttggagcaagcgacggtgtatcctatattcggaagtgaaatgtcagacctggaagcagccttgtgtatcctggcagctttttattccacttatgagaattcacagatcgacgaacgtacaaccctagtagatgttataaccctcctgcctgtgatattcagattactcggcagtgaaattacagcattgaaaaatgtctctccttctggcacctattttggatttaatgatccttcttgtatgaaattttttgttcccatgagaaaaggcaagcattatgcagaaaacacattcgggaatcatgtgcttataaagatgttgctaggtagaggggtaatgcaaaaaattcccggtgagaaaattagccaaaattttgatgttgaagctcgtttacacggggccattaagaatgatgttttggtgtattggacatatcagctaatgaggccaaaattgggaaataatgttccaatcttcatacacgatcaacattatttacggtctggcttggttgcaattgaaagtctttttttattgtggcggatcctgaactcagaaagtttgtttaacaagagagttgggaagtttctcttaacttcgatttttccacagttggagaatgtcgatttcgccgaaaataactttgaagctggaaacattcaaaattttgaatacttaatgcaccattacgttgtgcctatgtacaacctgcagaatgacatatcaatttcgactctttttcccggtctcgtggccgtgtgtgtaaatgagagtgtgagattgggatgggaacataagtgtgcgggggctccgtccgatgccgttcaggttcaatctaaggaaaatccgttcgtggagtatatccgcgctcaaatggaacaacaagcggatgtggcgatacttgaaaagcatgactgcattctctttcatcttgaaaacggtttaaacatcactctatcttttacattaccgagacagagattgtttgcaatggcttcttcattatttaatgtaaatgatacttatgatttcatctattttctagttttgggttttctgccaataccggccgttatataaggcgggatgttgtgttgattacgtcaatacggatggggttttggatataaagacttacagagcttttaaagaatcattacttcgtttattcaggatggagaaagaaacgaagtctttggcttggccagccactgcggagttttatggttgggtatttattttttcgtccatacagttgtgtacaatggttttactgacggttaggtttaatagttttaaagtcggtcgagaatacgctgtgtttacatttgccgggatgagctttaattgttttttacttccgataaagatgggattgttgagtggacattggtctttgccgcgagatttttgcgcaattcttctctacatcgatgatttttctatctatttctcctcgtggtcattggtgtttatggcgatcgagcgcatcaaccacttctgttacagcacaccgttgttgaacgagaattccaaggctctggcaaaggtgtgtttcccgatagtttggatcatatcgggagtgcaagctcttcagatgctgaataattacaaagcaacagctttgcagaacgagaccccacagtgttttctcgcgttcttaaggagcggatacgacatgtggttaatgttggtttattcggtcatgattccagttatgctggtgtttatttacatatacagcaaaaatttcatgcttttgaaagatgaactttcgaccgtgactacgtatctctgtatttatttgctgctaggtacaatagcgcatctgccgaaagctggcttaagtgaaatcgagagtgacaagattttttatggtttgcgcgatatttttatggcgcttcctgttttaaaagtttattatatacccgttatggcctattgcatggcatgtgatgatcacactgtgcccgttcgtttgtgtagtatctggctggtcaatttgtgtaagaaatgtttttcgtgtacgcggcgcgaaaaggagtcggatttagaggttggaataaaaatgttaaaatgagtaaggagtttatcgtttttattcataagagaatagatcttcggcgctgattcctgtaaggtcaaatatggcagagctgtcgagtaattgtggattttcagacataccgcagaagactttaaagtcgttttggagaaatgaaaacagtccggctttgtgctcggctctttgctgactgtacgccagtgtggatatctcaaattttccaaacattataagataggcaaaccataggtgtttgcagatgagccgcactgttggttctcgttcttgatccccccaaaatcggttaaagaatctgcagatttttaaaagtcggtgattatagatagctccaacggagaaaactatattgccttcgcagattaattcttccggaattttgagatttacaccaaactcgtccatgaaaagaaaattaatcatgtgactaacatttccgctgtagtgcagcttttttgagatatatgctgagtgactttcgttaaacatatgtcggagtagttccgcgtcagaatgctgtttcagaatagaaaatattcgaaaccagtagttgttgctgattttacgattcaaaatcactatgtctccgattccagaattgtacaaactttcgcgtagtagtaagatcttgattccgtgtgacagcattgatgtacatacgtgttgaattaaaagtaattcctcttgtttaaagctagtcagattctcgtttctaagcagttttgtggttatgtgtaatattaaattagggacggcgtcgttcaattttatgtactgtcctatctgggtcatctcaaaatgtctaaagtttgggtaggtggattcctttgtgtttatggtgaagaaccgtcggaagaatgtttagctctgcccagggacacggttcaaaaagaactggggtccggaaatattcctttaccgttgaatattaatcacaacgaaaaggccactattggaatggtacgcggtcttttcgatttagagcatgggcttttctgcgttgcgcagatacagtctcaaacgttcatggacatcataagaaatattgccggcaagtcaaagttaatcacagcaggctcggtaattgaacctttaccaccggacccggagattgagtgtttaagttcaagttttcctggtctatcgctgtctagcaaagttttgcaggatgaaaatttagacggtaaaccgttttttcatcatgtgtctgtatgtggagtcggtcggagaccgggaactatagcgattttcgggcgagaaataagctggattctagataggttttcatgcattagtgagagtgagaagagacaggttttggagggggtcaatgtttattctcagggtttcgatgaaaatttattttcggcggatttatatgacttgctcgcggatagtttggatacatcttatattagaaaacggtttccaaagttgcagttggataaacagctatgtggtttgtctaaatgtacgtatattaaagctagtgaaccacccgtggagattattgtcgcagcgaccaaagttgccggtgatcaagttcagttaactacggaacctgggtctgaattagcggttgagacgtgtgacgtgcctgttgtgcacgggaattacgacgccgttgagtctgcgacagctacaacggctatgagtaatcaaaatttgccaaatactactcctttgctgtcgagtccaccattttcggattgtgtttttttaccgaaagacgcttttttttctcttttaaatgttacaaccggacagcaaccgaaaatagttccgcctgtttctgttcatccgcccgtaactgaacagtatcaaatgctaccgtattctgagtcggctgctaagattgcagaacatgagtcgaatcgatatcacagtccttgtcaggcaatgtatccctattggcaatattcccccgttccccagtatccggccgcgttacacggttatcgtcaatcgaaaacgcttaaaaagcggcatttccagagtgattcggaagatgaattaagtttcccgggagatccggaatacacaaaaaaaaggaggcgccatagagttgacaacgacgacgataaggagatggctcgagaaaagaacgatttgagagaattggtggatatgataggaatgttaagacaagagattagtgcgttgaagcatgttcgcgctcaatcgccgcagagacatatcgttccgatggagactctgcctacgatcgaggagaaaggcgccgcgtccccaaagccatctattttaaacgcttctttggcgcctgaaaccgtaaataggagccttgctggtcagaacgaatccacggatctgctgaaactcaacaagaaattgtttgttgacgcgttaaataaaatggatagttaaaatgtatttttatgttgtgatcaagtggtgtttagctgtgtgttataaggaagattcagagtgaattcctggacatggtgaaacttgacacataattgtttaccgacgcgttcaataaaacgaatggttaaaagttgttttttgttttttttattttcgtataaaatggtatttaggcgctagttacggggaagatctatgggagtgattgtgacaaggaatgaaatgaatgccgacatctccttctaatatcgttaggttttgtggggttccaggcggcatgaattccatgcgagtagattctccgggttttagagaaaagtgcaagggtaccatatgtgcggtgtcgaacgcaacgcggagtgaactcaaaaaaattcccatgttgatgtctggcgttaagtttgcaaccgtgcttagacttggtgttcgcaatactgcttggtttgtgaaagttacggtgtttcttacgggaccatttggagattctgtgtttacataaattttgcttgcttctgtccagttgaattcgacattattccccggtggtaaaatttgtttggggaagaagtatactacgcctataggttgcgagtaattgatgcgacggttcttcttaaatgctttcatggtgatgtagagaggccgtgtctcatcccaaatgccggtggttgtagagattccgagcaagagtttgggtataaataaacccgtaaagtttgaatttgaattaaagatagtgttaaaagaacaatggacaggagtaaccgtgttagggatgatatttttagttgcgcagacagttattgaatgggtgttgcattttagaagtgtttcttgattctgcgacaatgtaatgtctgcggtttggggggtcagtgaaatttgtatggcaagttgttcaggataaaaattatcgtcaaggagatagtcgttttcgtagtttgccttcaaaattaatagatttccgcagagtaagattctagaaatatagacgtttttgtgtgatataaattcgatgttaccagttttaaaaatttggtcgagcggagtgttttggagattaacccatatctctgccttaaatgaatatcgtgttggctcttctggtgtttgttctatccatcgtatatcagccacttgaattttaatacgcgtgagagggccatatatgacaaacttcgcgtcgcactgtccgtggggtataatgtggcgatcgtgggcttcgatgcgttgcaccggtaaatttgatatattcacgtttgcgtgaggaagtgcaaatatattaaggacgataggtaatctactgagatccagatctagatctgagatgttctgcaccgcgaagggtatgttgccgtaatcttttggatcgatgtaagtaaaaggcgatgatgtaaaactgctttcgtctctacaaatgcacactacggcggatgaagggggggtgatacctaatccgcatttaaacaatctcagttcgccgggttttaatatggcggtagttgttactcttagctgtagtacgtacgaagaccattgtagagtggcgggttgcatgtttgcttttctggatgtctgaagggaatcctgttagtgtattttggatgttaaatagttgatgtaaacgtagagagtcatatgcgtatttttataatagagtgtttttccacggacgggagagtctgcgggtttccacgcgcaggcttgtcttcgtattctaagggatgtaatgtgagttccggtagcaagtatgcaggaaaacaattgcccatgaagtgtacgtcgaatggtttatcggtattctccgtgtgtgttaaaagagatttcatgtcgctgtttgagagtgaacgaaacggctttctaaacaacttcttcgtcacaaaaaagacacgccctaacatgtcgtgttcggttacggaaactgttctttcgcacgaaatccgcaattttaacggttcttgggcaaaccataaaaatggatacagcttgaagacatgcgtctggacagggatgaagatgcctacgatttttttgttagtgaactcgccgcgtagcgtgatctctttgtttgtattacttactaaggacatatcgttgggaaagaaaacctctagattcttcccgtctgcgcagattttaaaatacggcatattcatatttagcgtgacggtgctccgatcagggggggaaaaggtcaagcgaagataacattctttcgtgattggaaaccgtcgcttgttttccggcaacactacgttacgcaaaaagactgtgagaaaaggatcgttaaattctattttgtagatagagatgccgggttcggaaatcatgttgactctgcagagtgggatgatacttttgaataggttttcccaatagggacattctctggtatcgatgctgaacacgctaaaaactattagcagctttctgccatagcggtctaatttttgagactgataaggactttctgtccagtttaggttaaataagatcaaagacatttcaacgctatcattctgaactactttaaattgatttatcacgttggttgtcgagataggcatattggttaggccatattgttcgtatacggtcggatcgatgttttctttttgacatagcgcattgatgtcgtcaatctccagtgcatgtgacggcagataaatgggtatggaaaataaatgaatccgtacgggaaccgtcctagaaataggtaaaatttttattttgatagtcgttgttttttcgagaaactgtacatcgaacagaacgtcctcagtttccgattcagtgccatctgttatgaataggattcctggttttgtgcttgagattcgacatttcaaaatgatttcttggtaagaattcgaaactatgtgattgcaatcaaaaacgagttgcaagacatggtttagttgaggagaaaacatgctggtacaaaaaacattttatgtttcatctccctttttaaatactgtgtttttttaagggatgaggtcattttgtatgacggatggaggacgcgggtgtcccggcggggtgtgtttttataatcctgtgtatgagtgatagaaaagtcatagtaggctagtgtttttttaaaaagcatttaatttttataaatacatgtagccattctgttatctgcggaaacgtcacagacaacaaaatacgttttctcgttggtcaaagaattaatttggtcgatcatagttaagactgatttgactttttttaattcatctttaatttccgtagcgtgaagttgtccgcagcgctgtgtgtttaacgttgttcttttagataatagttcttggcatttgatcaaaagcattgaatggtcttccagcgttagccgatctatgtaagttctcacgatgtctggggccatggccgtgatcatggacagcgagatgcaagctgttttcatggagtacattgattgtttgtcgttgactatgtctggtaatttaatgagtacgtctctgtattggatagagcataactcatcgatgattgtttgcatctcattgtattctctgtgaactgctataagaccaatgcatagcaatctgatgttgatctcggccgcaatggctgtcggaacgactaaaggtacagtgagctcccaatcacctagtttcaatagcttttcttccgagtgcgtcgataaaggtggaatcaatgtcaaggtgtcacccttttcccaggggaagggtcctgtgttctttatggcatactgatggccggtcaccggctttctcaaaaccagttgattgccttccaccttttgcagaatggttacgaccatggtccgtaatacgtttcggacgtggacgtaatctttgttggaggagacgatgggataaagacctaaattgccgctacctattagatggtggtgagctgggatcggtatgacgatgttcatgagcttgcatagggtgctgatatcggaaagtgacagtttgtgatcgaaagtgcagtagacggtttccattttatatggatgattcgataatgagttggaaaggtatggtttctcctatggcgtaattacaataatgggtttcgctgatctgcgtattgccggttttagaccgactctctaatagagcttggttggatgaacagtgaagaggcagagcgttttgtaagaactggcatggtctgcttacgaagctatccgtgccctcagagcacgagtattgtatttcgctatcgctgtttaaacacgagttcgatttcatgcagtattcgcttatcactttgtacatcatcttgtttgtttttaagatgtcagattcggtaaaaaattgagcgttgggactgtatgtcttggggttgtaacatagttgttctctgtgtgccgtgttgtatagaatatcgcctaaggagcctggtagagatgcccaagggtttgtggttgcggcgaatgtatcgctgtctgtttgggtgtggtcgtacaatgcttttctagccgcctcttcgttgtgcgggtccgttcccatcatacatgattccctgcctcttgggttgtggggcgatttgaaaaagttaatgtttgtcgtaaccggggtcagtataacttcgcagatagcttgttgaccatgcagtagtatggagggtgggtttttgttaattccgccgaacgttatgatgtttagtgcttcgctctcggagggattaggtttttctatcccgacgtgatgtcgaatccacgtatttatgtccgcgttggtaaacgcgtgtatcgggaaggcggagaaaaggttttgtatcttgctccccatatctgatttaattcgcttaagattggcagtggcggtggtagagctaaaacctaagcccatatctacaaaacttaggtgctgggtgaagttgtaagtggttgcgatatctttagcttccgcggtgaccgtgggatcgtctaaaattatagatgtggctgctctggaactgtataataggcactcgacgtcgaaattatccgtccggactagtgtggccgcaaagcccggatggattttgtttttgctttggatcgctatggcaacgggagacaattttgagtgcatggcggcaagcgtcataatgctcaacagggaattggggcagaaggctgagtacacggaaaacggtgttcgttgccaattataaaattctaatgctaatgggggcgggagaggaaaaccgccgtcgtttctttgacagtgaggaaatgtatttaggaaaacttggatatcagcattcatggtgccgcagattcccgggtcggagaagaatcgatgaaatgggattggttgatagtaccgtcttagggtggtgatcggtgagatcaggcaaagcccgttgtatagaatgtgttgtagtgattgaaaatgaacggagttgccgtgtcgctgcgcgggatctaaggagacttccacttccaatattttcgtattttcattaatgtagattagcgatttaaacaactgttttgcgatacaggatgtgttggctacggtgtagccagggcccataccttctcggatcagagacattagaacgtcgctggtaatcggattctcctggaaataatcatctggactgatgaacggttccgtgtagaataagtctagaactagttcctttacgttgacgccagcgccacaggccttgttatttgatagtgccgggagtacgcagaagtaaaatatcttgctcaggatggtggtttcgttcgatggtctgtcattgtcggtaaagacgacgcttgaatctattagattcattctttgcacatcggatatttcgtaatttctaactcttacggtgttctgtgtcagtggtgtatcatccgctgttatttttgcattcgtgtcgtttctgggcatggtatggacgaacgggcagaacagacgtccgtcgaacaacgcgttggcgaaattcaccagaggttcgccgcaaagttgctcgttgaggttggagatagagattgttctcttcactaggcgaattagcgacacaagatttctgtagtgagcgaaagctgctcccgggatcagttcgtcgcccatgtggttagagattagcatgatcatctcgaagctgttgcaaaaaagaagtatatgtttcatgttaaaccaataagaaatacactggctaattacttgttttaggatcataaaagcatgcttgtttccatgcactaaggtctcgataacgtaagccaattctgggtacgagccactcgtcaagctttcggtgacaattttgagggtgaagtcgtacttttggcagttcgtctttgcatgttccagtatttgatttgtacgggcttcgtggaaagagactggagctaacggtaaaggtatgttgcctatcattattcttggtgtgcagagtacttctgtggctcggtttttctggatatacgtgagatcgaagaaggggtgtctttcggtcggcagtgttggattgtccggtttgtaaaaatcttcaatgtttaattcgttttttaagacgttggtgtttttgggtacttcttgtcgactttcgtataagttgtataaggtctgtaagatcctggctgggttttctcgggtaatttttagttgacatagttgggaaaagcggtggccggtaggcaatggttcgcttttcatgagtcgttcgacgatggtcgagtcgtggacaatgggatggcaaaccgacggtaatatgtcggcaaaatcaattcgctgcacgacttggtctttattgtggaaaaaaacgctggtgggtaggttgttttccatggtgtcgtttaatttcacacgtgtttccattgtactgaaaccggtctcgctcggtatgtagatacccaaagggaaaaagaatgttagttgtaagctctgttctagcggatcgttgacgtctgtgtttttgtaaactttgtgtaggtggtcgaatgcgactaatttatctcccaatttcaacgtgttcagctttaggtcggcgtacgcgcggcttttgtcgaagatttctgatttgttgttagtgtcttgttgttctgtcccggcgttcacggtgaattgagtaaaatcggccatgattgcacggtatgcaatcgcagtcactgcgttttctttgcccataataaagtgaccatatgagattggggcggagacgacttgtgtggagatgtactgggagagtatgctggtgagtttttggatagagccgatcggtcctaataaaacaccatctagggggacgttttctttggaagtgtagttgttcgtatcatttagaatgctttccgtgaccgattccatcatgtcgtttagaattctatagatatatgaaatattattattcctgttcaaaaaaaataatgacgttaacaatctgttcttcaggctctgaaacatgttgctgcgctgtactcggctcagagcttgtttattatgtactttgttctcattcatggtcaggacgataaattgcgggggagattttctcaataaggtttgcatgaatgcgtgaatcaaacctcgctcgagcgaatcggctgaattctttaaagatcttaagactgtatgtaacgcattgatgtttaaaatctgatcgatgactgtgtttttaaatgtgttttccagatgttccagacaggcagcgctcaaatcgaacgatatgtttatggggtgtttttctgagtgtttggctaccatgatggtggtttcttttgaagcagttacgtcgtttcctgtagcgactctaggtaattgaataaagaagagaaccttcccgagggtcattcgactcacatcattgaagcggattacgttcgctgcaacggcgatcggcgtggtgaaaaagttaatccattctattttgttgcagtagattccgagtaaggcttcaaaactgatgttgtaacggctcggatcgtcaccgaaataaattcgcaaattgtcaaaaagttgttcggctgtgtatgttttaatgtcattgaaaatatttagaggtgcttcgatcttaggtaaaatttcggtcgcctgccaattttccatgtttcggcgttatgcagcacaccggtaattgtgaaactttaatagttaattcatgttttggttccacttgtgcacggtcgattccagtttttatagattcgtgtgatctgaccgctgaagtgtctcgcgacgaggaaactcgtttagcgcgatccatgcctgtagttctggaaaagatcgagtcaatcatagagaaaatttttcaaacgtccgggccaaatatcgttcacgataaagacagggctaaaattgccttgtgtcgtctgttgttaggaccagttgcggtgccatgcttctgtgaagagtgggacaccaacgactatttgtcgaaatctggctgtaaatgcataggtccgatcttatatattcataccagtcgatgtcgttgtagcgacattccggtttttaagttttctattatgaaagattactatgcttcacacgtgttcagaggtttattatctctgaaagagtggaatacacatctaccgaatgtattgtgtacgtgtgagttgtcgatgagcgatagatatgtggcgacagtgtatcctaagcagaattctatttatctagaatactatccgtattttttgtgctacctgtgtcgccatcttactgtcattgagattgagcagtgtacaaatgatttaatttcgcttcttggccctaaagtagctcagcgagtcataattcattttaaactgctttttggttttcgtcacaagccgcatattggtactgttgattcgtggttctgggaaaatttttttatgttagaattgcataagctttggttaaccgtagtcaaacataatcgggtgacgacagatttttttaatgtagtctacgagaaaattcaaaactataaacaatacgcaatcaagaccctgaggatgtcgtctaaggcggttcctgcaatacagaggttgtgtttggcaaaatttaagcagcaattgttgtatctaaatattaaggttacggtaaaaaaaaataagcgagaaatgtgtttgaatggctttgtttacggtaaaacattgtatgtcgttgaatcttctcagttaatcttccggaatttgcttctgttgtattacgattacagtttgccggacgaatgcaagacaaacgaagaaaacgttttgacggctcattacatacgagtaatttcgagattgtcgtttaagcggtctcggagtgcgctcccgccaggcgtgagaccagattttatctttgtggcacaacagcctaaacgtaaagagttacctaatgttcccggtggtatcgattttgctgaaattacctcagtgaggcatggcgcggtaactcttaacgcgtttaatacgaacaaagtcatgaatttaaaagcaaccatttcaaaaagggctaactttgtatatcatcgcattcctaagacgatgacccacagttttgtcatgtacaagcatacgtttaaagaacctgcgtttaccgtaagcacgtttgtttcaaacgatgatttagatatgagttcgttgaatatcaacatacgtggaccttactgcgactttttatatgctttaggcgtttataagatgcatgtttctatccgagatctatttttaccggcgttcgtttgcaatagcaataattcagtggatttacagggactggaaaatcaggatgttgtgagaaatagaaagaaaaaggtgtattggatcactaactttccgtgcatgatttctaatgctaacaaagtgaacgtgggatggtttaaagcaggaacgggtattattcctcgggtgtctggggaggaccttcaaaatgttttgcttcaggaattaaataacgttcgagagattcccgggttagtctttgatatggatttacatcaactgcttgttttattggaacagcgaaatctacatcagattccgtttctcgttaaacagtttcttatttttttacgtctcggtctgttaatgggttacgggcactctcggcgcaacaaggtgcatgatattatgttacatttaatttcgaatggtctgtttgattttaataagaactccgtagcaaatacaaaaatcaaacacgggtgtgcgttggttgggacgcggctcgccaacaatgttccgaaaatcattgctaggcagaagaaaatgaagctagatcacatggggcgaaatgctaattcgctcgccgtgttgcgttttatcgttaaaagtggggaacagaaaaataaaactgttttcattaaattgttggaatatttagcggaaacctcaactgccataaatacgcggaatgaagtcgccagattacttcagactctgacggctaaggtgaaaacatgaatgtactcgtggccgacgaatggttcgattgcgcgattaggttagattcggaaaccatagctgtccatgagattttcaatccggagttaagtaaactgcttaacttgcactcgaaaacagtctacatgtccgacctatgcgcttttatttctggttgtgttaatcggaatgtcggtaaacttaccatatattggcatgtgaacggagatataatctacgcattgacgggtattttacattgtgtaaaaataaagatagagtgcggggagagaattgccgatggtcgatatagattatacgaaattcctaaattatttttaatgagaggacagtcaacacccatggaattgaagtggaagcacgccgtgggtatcgcgacgacgaataagcctttgctgacgcacgttttaacagatgtgttggaaacatctccttttaccttgccagatacgcttctgtcggtgcaggagttgtctattttcagagagagattgtcgtacatttactatgtgctggggtcagatgttgatatcgtagcgcggacagagagagagatttttcaaaaatgtgcagaactagctcgcctacagcaagtgttccttattcaaggaaatattatggaaaactttgtcctcgcccaggcttgtctatttcagctgggggctgatggtttgtgggaagagatatctggttctgtacgtcctaggccggaattgatgtccagtgcgttcattcaacacagagtaatgttgaataattgttattgtatcgctgtcatcttcaatgccatttacaaacacaaactttccctgcctaccgtagaaagaagccacgaaaccgttaatcgtgtagctcaggaatattataagtcttatgtgaatgctcctctctctgttcttgtgtgtgcgactaaggtgcttactttatttacagaagaatataactttaagtcagctctcgtatttgtcagtcagtttttccaggtggacgtcgaggcttcgagagcggatgtgattcgtctgtttttagcgtgtctaaagggtgattaaatctctcggaaagaggctgaactgtttccagagcatacataaatcgccataattatagcgataattaagtcgtcggaacaggcttgttttttagcgctgtatgttatgtaattgttaacggagatctggtgaatgtttctgatttgttctagtgcgtattccacgggatcgtaggtaatttttattgtaaacgatatcaattcctgtgacgccttgatgtttcctgaattaaaattcgagataaaaaactcaactgctagttttttttctttaccgagtaggtaaaatggctgtgctatctgattttggtctggggtgtggaaaaaagtcacctgtatagatttattagccgtgatgttttcctttatgatacatgcaatttttacggcagaagcttgattggaattcccttctatgatgatttttacttccgtgaagaaaggatgtagatctaggattgacaatatcatatgcgcggcacattcagctattgccgtgtcggaacttgtcattaaactttctagaaagtagtgctccatgccgtagacgatatattgatctagataggtgcctattgctgctatgcctgtgccagaagcacggcggttgcctgtataggcagggtctaggtatacgtacagatctttacctaaaaagggaattagatttttattgatggtgctgtatcggaaaaactcgaattcggtttggccttgttccgtaattaaaacgtcgttgatcacattgcaagtggctccgcccatgatttcatggatgaaagctccttctaggaagaggttggccgtttttttaacttcggcgttaatgctgatgaacttgggtttgtggagtcggtagcaagaacaggctgtggcgttaccgcgttcgtttaacatatgggcgtgatcttcacatacgtaagaaactacggagagcatttcaaacggagagttgttcagcttcattaaaaaagatgttgaatggtttccggaattggtcgaagatataaataggatcttggtagatgcttggggcaggaaacctaaaatcgtgctgaacgcgtctttctttataaagtggctctcgtcgacaataagcagattgaagctctgtccgcgtatactctgagaggggaatgaattcggcgttaaacgggataaaagacgattttgagaactgtgaaacgaaagacgacctttttaaaataattgataaaataagcaaaaattgcaattttatagtggaacaggtcgagtctttgcctcggagggtggattcagcggccatcctatttgataatctcgcggtggagatatttaacgatgtaatatatcgacaaaatggagttgccgcgaaaatacgacagggtaacgggcaggatattgacacataagaataaccagatgtgtacaaccgaatgttctcagatgtataatttacacaatcctatcacgtttgagttgggacttggaaacgtgtttgtctgtatgcggtgtttgacggttcaccactgtgatatgcaaactgactgtaccattgtcaacacgcatgaggggtatgtctgtgcaaaaacgggtttattttatagcggttggatgcctgcatatgcagactgcttcttagaaccgatctgtgagccgaatattgaaacggttaatgtcgtggtggtcttgttatcttatgtatatagttttttgatggaaaacaaggaacgatatgctgccattattgatagcattattaaagatgggaaatttataaaaaacgtggaagacgctgtgttttatacttttaacgcggtttttactaactcaactttcaataagattcctctgacgacgataagtcgtctttttgttcagttgattataggaggacacgctaaaggaacgatttatgacagtaatgtaattcgcgtcagtcgtcggaaacgagaagacagtttactaaaaaagatgagattggagtatggaaacgcacttatactatgacaccctgtatcaatatcaaggcggagtgtatccggctcatatttgcctgccgacagatgtgtgtcttccgatgagagtggattgtatcgagtctttatattttcggtgtgtattttttaagagtgggatgcattatactgaatggagtaaattaaagtttactgtgatttcacgtgaaataaagtttaaagatgtgttaaaggatgcggactctgacgaagtttttaccggtttggtggtaatgactatcccaattccgatagtagattttcattttgatatcgattctgtaattttgaaattggtttatccgcggttagtgcaccgggaaatagtgctgagactctacgatcttatatgcgtcagacctccgtcaaaccggccgtcggaagcatcagctaaaaatattgctaatgatttctatcaactaacctcacgtgaaaataaacagacacccgatgaggaaaaacgttgtctattttttcagcagggacctttagagccaccctctaccgtcagaggcttaaaggcgcccggtaatgaaaagccaatacaatttcccgcccatgctaacgaaaaaatgaccgaatcttttttaagcgatagttggttcggacaaaaagtcagatgcaaaaaaattttggattttacgcaaacgtatcaagtcgtggtatgttggtacgagctttcgttttcccgcgagatgcagatcgagaataatttactgtccgcttcccagctaaagcgggttaacgctgcggatttttgggatagaactaatcggtatttgcgagatattggaagcagggtattgacacacatcgtgaaaacgcttcagattcataataggcaatttaaacagaaatttaattgcaattttccagataatttcagctttgatcgtctattatcatttatgcagctcgggaaagatttttggattttaaacttaactttagacagctgcattattaaggcaattatctgtttcctaggttttcaaaacgggggaaaatcttttttagcccaagatgaagtttggggggatttaatagactgttctaaaggatcggtgatctacggggaaaagatccaatggattttggactcgactaacaatttatattcgacgtgtcgggaaaaacagaataagtcgtgggaattatatgttgattgctgtgctttgtatgtatctgaaaagttagagttggattttgtgctacccggcggatttgcaatcaccggtaaattcgcgcttactgatggcgatatcgactttttcaattggcgatttgggttatcttagaaattttctgcagaatgaatgtaactggttcagaatttgtaaaaaaacattctatcgcgaatatcgcagcgttgcgacatcgtctcctacattctcgttgaataataagcctaagaaattttgcatgcattgcgagattgtaatattcaagcgaagtgaagaatttatgttcagccttgcggtaaatggcatacattttgggcagtttttaaccggaaaaatgaaatttaataagaaagcagttccggaagggctctattactatatattggaattgggaagcataacccctatcgatttgggctttattccgagatataattccgactgtgttacaaacatgcgttgtgttacaccggaggttatttatgaaaattgctctattgtgtgtcccgaagaggcaaatcgcctcacggtaaaagggtccggggacaataaattgactcccttaggtgggtgtggagcatggtgtctgaaaaatggtggcgatctgtatatctatacttttgcactcgcttacgatcttttcctaacttgttatgacaaatccacctttccatctctggcaaaaattatttttgatatgatagcttgcgaatccgaagattgtgtcttttgtaaagatcacaacaaacatgtatcgcaagctggacagattgtagggtgcgtctctaatcaagaaacctgtttttgctacacatcgtgtaagaaaaaaatggctaatattaacaatccggagttaatctctctgctctgtgatcaggaaattaataagatagatattatgtatcccaaaataaaagcatcgttatcactggacattaattcttacgctcatgggtacttcggtgacgacccttatgcgttaaaatgtgttaattggataccagtcaggatcagcgcagctctgagcaggctgattgttttgtcgtgtcctgtgtgtaagcgtgtggtaatggactaattgtgtgttttatgtattaattttttatttctgaaaataaagttaaattgatagtacttacgtgtgtattgtagcagctggcgaaaagtgctgtgctctttatattttgatggtcgattgtaattacattatccaggcatgtgattgtcttttctggaaacattcggcggcatttaaactcgacttctttcatcacaaagtgagatacgtgtttttgatgtgccacgtaaccgatgctgattccttcaatgttcttcaataaaaaacttataataggaactatgaaccacgtttttccatgtcttcttgggactaggaatacgttagttttttgtttcagcgtattcagagtactttcgtttacgaattcaatgtcgaacacgtgggtcagatagttgataacacgattggctaaagctggaagtttggtgacggcgatgaagaagattacatgtatgagaatgttcttctgaaatggttccagttgtattttgcgcgtgtctccaaagtcgttgaattctcctttgatccattttctgaaatctttgataaaaccgtctatttgcaagaacagcggttcacgatatagaatcttaaaggattcaagaaattccgtgtattgtgattcaaaggatttgtcggaagcgggtaaaaacttcatttcttgtagcttgtgcgaaaggctcggtagtatagtaagaggcttacggtttttaagatgtcgctgtttttcacaaaatgtatatagaggttttacctgttggttatatgaatgggcaaagccgagttctggcgtgagcattataaaacgcttcttatagaagatggcactgttggggtacttggtagatattgtcgagcagtctctttcgcctttccatatgatcgcttcatagttattttttatgtgggttatgtcgcaggtacgtagcatggagcccgaccttacgttggcggcggtctatcaggcggcggcgaacctcacagagcaagataaggagatttttgccgaagcggtaaaaactgcgttttcagtgtgtagttcggcagccccgagcgctaggttgaggatgatcgaaacgcctacacagaattttatgtttgtgacgagcgttattccttcgggtgtgacgtctggtgaaaaaaaaacaaagttaaatatcgatgccgctctggataatttggctttgtcgtttgcgaacaaaaaatcaaagaagatggctagaacgtatttgctgcagaacgttttgcggactcaagatcaacaagttgccatttcggggaagtacattttgtatacaaaaaaacacattgaaacgtctttgatgatcgataagacgaagttagttaaaaaaattctcgagtatgccgagacccctaatctgttaggatataccgatgtgcgtgatcttgaatgtttactttggttagtgttttgtggtcctaaaagtttttgccagtcagacagttgtttcggatacagtaagacgggatataatgccgcgtttccaaatctattgcctccgtatctgtacgaatgcggccaaaataatggactgttttttggcattgtgcaagcttacgtgttttcttggtactcagattttgatttttcggcgcttgagatttcagaacgcgctcgtcgtcgaatcaggtcactcctgtacgacttaaaacagaagtttgcggagcaagaagtttctgttttatcggtagcgtcacagatgtgtatcttttgtgcattatataaacaaaacaaacttagtctagaatacgtttctggtgacttaaagacttctgtttttagtccaattataataaaggattgtttatgcgcgcagacgacaatttctacaactcagatgctgccaggtacaaagagctcagccatatttccggtatatgaccttcgtaagctgctcggtgcgcttgtcatttcggaaggtagtgtcaagttcgacatataatgtctttgaaggactatctgagacagtccatttctaaagatttggaggtgagacatcgagattctttaaagattagattaggggagagacatccattgagtgtgcatcagcatatgatcgccgctaggcagatcatcaaatcggacaatgcagaacaacagcatgtaatatcttctttgagtggttttttggataagcagaagagttttttaagagtgcaacaaaaagctttaaagcagctagagaaattggacgtcgacgaaataattgatacggcagcggaagtgaaagcagtcagtaatgatataaaagaaactcttataacaagcactgaattagaataattatggacaacggtgtggagacacctcagggtcaaaaaactcagccgataaatttaccaccagtcaggaaaaagttaagaaaacatgagggactcggaaaaggtgttaaacgaaaactttttgccgaagatagctctcccttaaagaaacagatttccgcctgcagtgatatggaaacactttcttcgcctgtaaagtctgaatgcgagtcgcgaagtgcttctctcgatgaaagtttcggaaaatgtaaacacgaaattgcttgcgattgttctgcgatagaggaattgctttgtcacgagtcgcttctagactcgccgatgaaactgtcgaatgcccacaccatcttcagctcaaacaaatggaaactggagctagagaaaattatagcttcaaagcagatttttctagacatgagtgagaatgctgaacttgcggcctacggcgaaactttgtgtaacctgagaattttcgaaaagatcagctcgccgtttttgtttgatgtgcaaagcgaagagcgttcgtattcagtggtctacgtccctcacaacaaagaactctgtggacagttttgtcaacctgagaaaactatggctcgagttctcggagtgggtgcttacgggaaggtgtttgatctagataaagtggccataaagacggccaatgaagatgagagtgtcatttcggctttcatagctggtgtcatccgtgcaaaatcaggagccgacttattatctcacgagtgtgttattaataacctattgatttcaaattccgtttgtatgagtcataaagtgtctttgtcacgtacttatgatattgatctccataagttcgaagattgggatgtcaggaatgtaatgaattactacagtgtgttttgtaagttagctgatgctgtaaggtttctaaatctgaaatgtagaattaatcatttcgatatctcacctatgaatatatttttaaatcataaaaaagagatcatctttgatgccgtgttggcggattacagcttgtccgagatgcatcccaattataacggcacgtgtgctattgctaaagagtatgacaaaaatcttcaacttgtgccaattagtcgtaacaaattctgtgacatgtttaatcctggatttcgaccacttgtcgccaatgcaatgatattggtcaatgtgtgcggggcttttgatggtgaaaataatcctcttagacactgtaacttggatctgtgtgcttttgcccaggttgtattatcgtgtgtgctaagaatgacggataaacgtggatgccgcgaagctcagttatactacgagaaaaggttgtttgccttggctaacgaggcctgtcgattgaatcctctcaaatatccatttgcttacagggatgcttgctgtaaagtattggctgagcatgtagtattactagggttattgttttaccgagacgtggttgagatatatgaaaaactatacgattttctagatgagagaggggaatttgggtcacgagacctttttgaggcaacttttttaaataatagtaaacttaccagacgtcagccaatcagagagggtctcgcgtctctacagtcgtccgagtatggagaaaaacttttacatgaccttagagagttgttcttgatcaattctactgcggatctggataaagatacatcatctctctttcatatgtgatatagtaatggatcttgatcaaatatctgaaacactgagttctgtggccgaagaagagcctttaaccatgtttttacttgataaactgtatgcaatacgggaaaagatcaagcaagttccattttcaattgttcgcttgtgtcatgtttactgcatgctaataaaatataacgcttctaacaataattgcattctgggccgtaaacttattgaggaaatgcagcagtttttgtgcggcacaagagtggatggatcggaagacatttctatggatctgagtgaattgtgcaagctgtatgattactgtccattattgtgttctgctctgtgtcgtgcgccttgtgtatctgtgaacaagttatttaaaatcgtagagcgtgaaactcgggggcagtcggaaaatcccctctggcacgcgttacggaaatataccgtgacggcgactaagttgtatgacatctatacgacaagatgttttttagagtataaaggacagcagttttttggggaagcggtgatttatggcgcgaaacatgagcgtgttattagacacctcgtagcgaccttttacgttaaaagggaagttaaggaaacgttgggattgctgcttgatccttcttctggagtttttggcgcgtctctagacgcgtgttttggaatttcattcaatgaggatggattcctgatggttaaggaaaaagcgctgatttttgagattaaattcaaatataaatatttacgggataaagaagatcactttgtttctgaactattaaaaaaccccacggagaaatccttttcggattttattttatctcatccggtgcctgtcatagagtttcgagaaagagggaagattccgtcatctagagaatatttaatgacgtatgattttcaatatcgtcctcagagaaagttgcgtacttgccccactccagctattttggcacctcatatcaaacaactgctgtgtttgaacgaaacacagaaatctacggtaatcgtttttgattgtaagagcgacttgtgtgagcagaagctgtctgtgtttcagaaggctgtgtttactgtgaatgtattcgtaaatccgaaacacaggtatttttttcagagtctgttacaacaatatgtaatgactcagttttatattaatgatcataataatccagaatatatcgaaagtacggaagtgccttctgttcacattgtgacggctttcttcaggagaagaacagaggaagaaaggagtttgcatttggtgattgatgagacagaatatatagaagaagaaatacctttggccttgattgtgactccggtagcaccgaatccggaatttacttgttgtgttataacagacatatgcaatctgtgggaaaataatatttgcaagcagaccagtttacaggtatgggcgcaaagtgctgtaaaccagtatcttgcggcatgtgtaagaaaaccgaaaacaccttgattgattacaagggaaatcctatattactagcgaatgaatttactgttttaaccgataccgaatcggaagaggaagggatggcagatcttgaaaagcccttacttgaaaaagtagttgctaagtgtgatacggaagctgaaaaaaaattgccttgtaaatcaaaaaaatgatagacgacgcagatttacggcacgctcgtttttttttattttttggctatttgacaataaacatgattgtaataaagtgtcactcgttttcatccattaggctcgagctttcagtattaactagttgcttgtaccgacgcttctttttaactaggtagcgtacaagtcgacaaattataaaaccgatcgaaattatggcgatgaccgctaaattgataataagtcctgtgctccactcggattcaaagaaagtttcgtactggagaataggaaaagataggcctacggcgccacaaaacataccgacgtaatagccaaacaagggtttaacgtagcgaaccaggacagcttctattactatactatatatgcaagccatgacaagaaaggtattgatggaagagtaagcaacggttatggaacgtatgtagatactatttccgacgcccaggcaagtagtaatgccgagaaacattgtagagtaacctagcatgagttcggttagattgataacaacggtcttgaattgtacggtcccctttaggttaggatgaattttctgaaaggcgaaaaatgacttatccgctgattgaaattgcgttatcagcgtaacgttaaaggtggtgaaacacacgaagaagatgcaataggcaaatgcgcctagggctaccagtctgaaagacaaggcggtgacgaataattgaaatgtatccatgattaagatgaattgaaagcaggatgacgtgtcccccatccaggtaatatccctcgttgtttggttaacgttagatgttttgttagaggagaacacttttgcacagcagacaatgtaataaataataatcaggaggaataacatagccattatcagtacgtagcatataatctgcacggggtttatgtaaagttgatgcgtcatctgatatatttgattgttagcggagagattaaccgctttgaggtcattaatttcaaagtaggcgcacggaaatcctaaatttggaaagtttatggctatcagatagaccgtgacgtttatgaatgacaaggctgcacagattatagagaccagccagatccgtaaattaatggtgtctacacgactggaggccataccagctctgtgatggagaacaggtttcagaacgatactctgttctcagagtggttcggtcagagtttgtccgatgtaagatttccggacaatgtcaccgtttattctcaagccgactcggcggtgagttttgaaaacgtcaggcagccgataaaactggttcgcgcagcgatgggttcaggaaaaacaacagccttgattcattttttgaaacaggtacccagggaactatctgtccttttgatttcttgccgtaaaacgttcgctgctgaaattttgcaccgttttactctcaatgggttgaaggattttgaattatattgcgatattacggagcggcagataaacaacagaaaagtcattgtccagatagaaagcttgcatcgtcttacagaaaattacgatgttttaatattagatgaaattatgtcgattataaagcagttttattccaaaacgatgacaaaaaccaaagaagttgattgtaagtttttatcgctgatcaaaaattccagtcatgtaatagccatggatgcgacgctgactcggcatgtggtggagttttttgccgcgttcaagccagatactcaaatcgccctcatcagaaatacatttgtgtccgcgatgttttccaataggatcgcttacttttgtgacacgttttttggtaaagagttttctttttttgcacgcttggaagacaagctacgatgggataagaaattgtgtttgttttgcagcaccgtgttggcagcggaatacatgtatgatttgatacggtctcggtttccactcaaaaaagttctcttgttgacgtctaaacaagggaaatgctcttccatagaatcgtggatacggtatgacgtagtgatttatacgtccgtcgtgactgtcggtctcagtttcgaaccggtttatttcagctctttgtttgtttacattcagttggccaaaggagggccggacatggtttcagtatttcaatccattggtcgtgtgaggcgagttatcgatgaagatatatacatttacatgaatcccgtattaattagaagctatgatcctttggcacctattgccatacctccgtgcagtgattggagtgtcgctgagcagtctatcatctcagagagttgcatcgacttccgcggaaagtgcagcggagcgcataaatataatttctgttccgtactgaagtctctttttcggtacaggcattatatcgaaaagactactattacaagtttatctgatagtttatttctgctatgcagtctgttatgtgagaattctattaaggtggacatcgttggaaatggattcccgatgcgcaaagaggtttttctgagtttcttgcagattctagttgaggagtgtcattttatcgaaaagaagattactttgccgggtgacgacatgacgttccaagagattataagtagcagagaaactatcatgaacggggatttttatgaaaacggtgatcagctattacataaggactatattaccgacatgggaaagttcagagcgacttttttatctccgggcgttgacattttcatcgcatcggacattgtatatgatctaaaaaatgaaagcaaacgctatgtttttgtgaacgtctggttgcaaaaatgtgtgtctgccggtgtggaaagcacggaaatcgaaagagttttttgtgagcggattaagtgctatatgctgccgaagagttttctgtgcgacgagtactttgttctaggtgacatttctggggtttacgagtggggaatgttaatagatctggccttcctggcggaaatgatccgaaaagatttgaaactgaaatcgtgcacggatactactactgacatttctgaagatgatctccttttgtgtgcggccaggaggtcaagtgacatcttacaaataatgcaattagtgtttacggtgcatgtgcaattttttcaaaaatacagtctgcagactctgcagctttttaacaagttgagaggcatgcggattgtgacgggtgtgttctctatagaaaaattcagcatttctatcctcaggcttttctttaaatgtgcatttaatatgactctgtccgccagcagacctcggtacattcccgggaaggcgtatcgcaatctaacaaaaaatgatatggagaacatgctagacaattgggagatttcgcgcaccaatcttaagacttgcaaagaactacgtaaagccctcaccgaggcctcgagagcaaggcggaaacaaacaatttataaactgcaaggctcggatataagcctctccgttagtgaagttggagttttcgggcaacatgcatctccgggggtgtgcgtgtcatcttagcctttattgtgtgtacaatgactgggagaataagatctacagagtaccgatttttcagtgtctgtttttagaagcggagactcgttcgttaaaaacgtttttgattaggggacagagcctagaccaagaatcgttaaatgagatagaagttacaagaaaagaaacaatgctttgggaccttcaggaacaaagtaatatgatggacaaaaaaatagcagcaatcagcaacctcattatgaataacggagagcttgttaggacactttcaaaatttttcgtgcctctaaccgttgttcttggagatgacgggttagagattttggaagcatacgtttgtggcgaggaactcatgttgcctctggacacggtacctgttatcttacggtgtatcggagactacgcggccttggacacgaagcatcttttgagtaacgaatgtacacaggcttccaaaaaaattcgctttggatacagtgtgatggactttcacttttcgctgactgtgtctgacgtgaaaatttgtttttcacacacggacaccggtgaggccgtatgtgaaaaaatgaaacaaattttttctttttctgtgtgtgctttcggcggtgagcaagttctcttagtgacgccaaaaaatgcttatgccttattgttcgacgatgatttgtgtttgcttttactgcagagcgtgtttgctttcctgcacgagaagatattcggagtttataaacaggtattagttcagctttgtgaatacatcggtcccgacttatggccctttgggaatgaaagatcagtttcttttataggatatccaaatctgtggcttttgtctgtatcggacttagaaaggcgagttccggatacaacttatatctgccgcgaaattctttcattttgcggtttggcgcctatcctgggacctcgtggtagacacgcggtccccgtagtcagggagctaagtattgaaatgcctggaagtgaaacttctttgcagcgtttcaggttcaatagtcagtatgtttcaagtgagtccctgtgttttcagacaggtcccgaggacacacatctattctttagtgacagtgatatgtatgtagtgactttgccagattgtctgaggctattattgaagtccacggttcctaaggcctttttaccatgttttgatgaaaacgccacggaaatcgatctgcttttaaaatttatgtcaaggctgcaacacagatcgtacgctttattcgatgcggtgatctttatgttagatgcttttgtttccgcttttcagcgagcatgtaccctaatgggaatgcgatggctgttagtgcgggacttacacatgttttatttaacctgtgatggtaaagatacacatgttgtcatgcctttactgcaaacggccgtagaaaactgttgggaaaaaactacggaaatcaaacaaagacctacatttcagtgtgcggaaatttcgcgctgtggatttatcgtctacgccagattttttttgagcagtgggttgtcacaatctaaagaagcgcactggacagtaacggcgagtaaatatttatctgcatgtattcggaccaataagacaggtctttgctttgccagtataactgtttattttcaggatatgatgtgtgtttttatagctaataggtataatgtttcttattggatcgaagagttcgatcctaatgattattgtctggaatatcatgaaggacttctggactgcagtagatatacggccgtgatgtctgaagatggacagcttgtgagacaagcacgtggaattgcgttgactgacaaaataaacttttcttattacattctcgttacactgagagtgttgaggagatgggtggagagtaaatttgaagacgttgaacagacacagtttattaggtgggaaaacaggatgctctgtgaacacattcatttactgcatttgaattaactttatttctttacataacatagaaaaatgagacttagctagatgtgtctccattcttcgaataaaaagtttgtgcgaattgtgttgctagttgtatgacttggagagaactgtcttgcagctgtctagattctaatgataaattgatgaaattgtgactacgttttgtgttaaaataaagttccaaaacttctatatgcgtgtttttcatttcattgtatagtctaatcatcagaggcaccttgtggaggatttctgaggcgtgttcgttaaaaaaaatgtgtcttagtgtacaaaccaacgtgtcacacgtgttaaataatattttcgttatcggagatagggctggaaagagaacgagcttagcgattagtttgtgtagggtgctttgcttcagtggaagattttctaatgcgaacactagtccgcaaagcataaattcttctggcgtatcaactttcatatggattagtctgcgtttgaactgaaagggattgagtcgcagttcttgcagtgtatcttccgagtctagtattatgatgccgatgaagccttgaaatcccaattctttttcgcagatggtcttgtactccaggccgttgatcatggttccgtcttccaagtggaaccatattccgtcatctcctactgttatatttactaacggatgtcgtgcgagtgatatacatttatcaatcttgatcacctttaggatagttcggacgtgtaagatgttgaatacgtctgaggtttctaattcttttaattttttcaaggatttcattctccgggtttggggagaaaatgttcgaatcgaaaatcggttcgctgttttcggggtgcgtttgggttaaattaaacacttctgatatctgatttagctctcggacgtatacgagtcttaaataatgcttgattttgctgctttcgtagatggctaataagatttcaccgagggatagaaagagaaattcttcgggaatcgattcgaggttgtaaatgtttaagaatcgccttaggaaaggcacgatgagcagctcgatgctatagttagagtatgtgatactttcttcctgtccttgattattaacgttttttcttaaccggaaggttcgcatgtattccatttcccatagctggtctattcgtttgtcggcatattgcgtgtctgggatatactgtgaaaaaaaactgttcgcgactgatcgggtgtcatctatggaaacgctagtgaatgggagcctttgaactatgtttagcgctcgagataaagagagattctcgaggtcatggtccagattcgggttatagcgatcacaatcgttattcgtctcgagcaaggagtgtagatccttgattttcctttcgaacatttggtttgttgttttgagtgtttcgatttcatccatctgtgtttgtatctgctcctccatgcacttgatgatttgttttttgaacagatctcgaacgtctctctctcctgtgtcgatcgcagagcgttttcggaactgtcctcggttcaacatgagtttattttggtctattatagagggagtgatttcttgaataaatccttcaacgctgtccctaatgcctattttagatttgctgtccgataagttgagtaaaaatttgattaaactttttttcgcgtcgctgcttttctcttctttttctatcatgtccattatctttttgttggttacatctgtctttgctgtggttagcacctttatgggaaatgtattcaataattggcacattttttgatgacgccgcagactattgtgtttttttagttctggagaaaggtgggcgaggggcgtagtcagcattaagcgatttctaataacatatggggtgctgtacgtgaaaaacgctatagccttcttgtttttaaaacaagaaatctgctccgaatttcggtctcggaaaatcttaatattgtgaaaatccggaatgatcacggaagatagacccagtaaaacgggagttacaatgttttgtttatgccgcactatgtcgtggattagtttagatgacacttgttgtaggagattgtataagttcggggccgtatgggtggttctcatgaacggaacgattcctacagtacagatccagtctacatatctgttatagtgactgttgtctatgctctgaagaataaaattaattatattagatatatcacccaagatcacctgtttaatcgcgtgggcccatacgctaaaataatcttgaaatgacaattttttgttgtggaacggaaatgacctcacatgacgtttccattcatcgtggatttgttgaatggaaacgctgtttaaaagggcttgcgctactccataggctatttgttttttcagtacggcggaatctcggagagcgttgtggattgtctgacctttgaaaaaatttttgtgtccgtgtagcatttcaataaaagtcattatctgctccgagggataaatcatgtctatctcttcgttgttcggaggtagatacgataataagtttttgcttaacatgtcttcggctcccaaaatagagttgattgtagataaggtggcttcgttatcagaaagacgcttggaggggcgtctgccggaagattggtttcgccacatcatggatcccgaaaccgagttcaacagcgaatttgctgatgctctgtgcataggtattgatgaattcgctcaacctctgccttttttgccgtttaaggccttgttagtaaccggtacggccggggcggggaaaacgaacagcattcagaccttagcggccaacttagattgcatcgttactgcaacgacatctatcgccgctcagaatttgagcgttgttttaaatagaagtaaatccgcgcaagttaaaacaatttttaagacttttgggtttaatagttcacatgtatctatgagcgaacgtcaaagttatattgcaaatgacgagaggtcgattcaaattcaacagaagcaagacctgtccatctattggaatgttatctccgacatagcggatagggcgttgggtgctgtcgcatgcaaaactaaagagttacctgatttgtgtgagagtagtgttatagttatcgacgaggcgggtgtaatattacgacatattctgcacactgttgtttttttttattggttttataacgcgttgtataaaacccctttgtatgaggacggaattgttccgtgtatcgtgtgtgtgggttcgcccacgcagagtaatgctttggtgacttcatttaatccgctgactcaaaataaggacgtgaagagaggaatagacgtactttcggccttgatttgcgacgacgtgctgtctaaatattgcgaagtcgataacaactggataatctttgtaaacaacaaaaggtgtgcggatcatgcgttcggagattttttaaagcacatagaatttggtttgccgttgaagccggagcttatagagtatgtcgatcagtttgtgaagcccgcttcgtacatcagaaatcccatgaacgaaatagaaacgacccgcttgtttttatcgcataacgaggtaaagaactatttccgttcactgcatgagcaggttgaagttaccaacagaaataacttgtttgtgtttccggtttattttctgataaaaaacaagactttcgaggactacaaaagtgaaattggcaatttctccttagaaattgaaccgtggtttaaatctaatattcatcggctgaatacttattctcagttcgcggatcaggatttatcgaaaacggttcaattggaggagattgttttggaagatgggtcggtggaagagactttgataacctgtcatctgaaacatatcagaaacagttcaataggtgtaacgtccaagatcaaggcttcgaccgtgggtttttccggaacttatgaaaaatttgtagaactgttacagagcgatttatttatcgaaaaaacgtcatgtgatcagactatccacgcatattcttttttatccggtcttatgttcggagggatgtattctttttgctgttcgaaattcaccacccctgaagtgttaatggaaatcaaaaacataaagatgcccagtattgaattcttagaaagtgaaatgtcgaggatgtctccggacgtacaaaccgtagagacagatgaaaggtatgatttcggattagtcaatgatgggttatcggatgtggatctattagagatcgatccttgcggagatccattttttactaggtatagtaagttgcctttaactaattctctgtcgttcgaggaaatcagtttgctttatacgacgtttaaggatatctttatatctaggtttgctattctgcagaagcatacaaaagggaagttcggaaagactctcctagttacttataacagaaacaacgtttctagaaaacagtgcggtgagatctattcccatttaaagagtttttatggtatgctcacttacgctatccctgccaataattatactctggagggctatacgaatgataacgtagttcatttaggaacggataaacaattaccgcagatcttatataaaaaaggattacctagattagttataaaagatgaaatggggttcatttctgttttagataataacgtgtcgaaatttatcgacgtcgtaaatggtcagagttttcatctatgtacaacggtggattacgccactgtttctaaagtttctatgaccatcacgaaaagtcaagggctttccatacaaaaggtcgcaatagatttcgggagtgatccgaaaaatttaaaattgagttctatttatgttgggatgtcacgagtaaccgacccgaataatttaataatgaatgttaatcctttaagactgaattatgagaatgataactttattgctccgcatattgtaaaagcgttaaagaacgaaaataccatgttaatattttagggaggttttctatgagtatataaaaaactaaaacatcagatgaattgtgcgtgtaattgttaaaatcccatacggtcgaatgagctcattcccgtcggtccgtttttctctgcaaaacaaaggtaccacggggatttagtacagtatgtctccaaacagagaagggtatgaaactttatgaggaactggtgagaaataacttacggttatgatttcggtttcgtcgcaaaattgactacagctgcaggggtgtggtctgagatgacatctgcaaaaaacaaatgaaagtctcccccggagtacacgtatgtactccggggggaaacctcaaaaatgcacaatttagcctattaagcagccgcgaactcgttaatagttactttgatgttaactcaggtggtggcttggatggtgtcctaagtatcaatcgaagctcctttattttttgcactactgaagttattttaggtatcggggtaagaataagatgacgaaaaaaatatgctagatccgtccattaaatcctagagttgtttttagtaataggttatttacaaaagcctgcatatgatccaatgtttctgtatgaatccagataaacaaaaatccaggagtaatgattggaatcacaaaatgattagatgcttaacttacttaataactatacttaactatacttatagactaaacttaacttatcaactatacttaatttttaggtccttataatgtgaactaaataatcaactgttttgtgcccaaccccccactactaaagcaatcgtctttgatttatgaaacaacgaggcccacttcacgttattacatagatcaaggtctatctcttggcggtttttgaattctttcgagagcgtaacggtttctaggtttcagacacgtttatccattcgccgggtatcgatcggatcatattagccgtgaataatctctgactttagatataacgtgtgaaaactagtaaaaaaggacaagagcagccgcctttgccgtcttcatgagcgttaaacactcatgaggttcgtatcttacaacacaatatgtgaaatattgtgagcgaggttaccggtgtccaagtcgtaatccgaaaatcatatattgaaacttgtaacaatgttatgcagttgtactcaaagtatatggtgatgaattgaacatgtttttgatgttttcgatggtattcgaaaataattttagatatcctgtagtttttttctgatgacttttctgatgacttttctgatgacaatatagaagatggcaaaacaacaagttactggtagttcttgatgttaaataaaatgaatcggagatatgacaagtagagagaggtaggtgatacgagtaaaatcgaagggtgtttccacacagacgggggggaaattctatgagaaccacagccagaagcaattgacgacaatagagaaaataagcaagcatattcatctgttatagaaagaaccagtgacctacgactttccattcaggctagcatggtgtgaacgagggttttttccgaaaaaactagatgactatttctttaagcaagtgtaatttttagcagtccaagtttttatgcaacgcagattttaatgatgtgtccctcgataactatacgctggaaactaacttacatcttagttgataaacgattttctattaaaaagactaaagggattttttgatatatacaaaattgtattgagctcttggaagtgcgtagatgcaaaataggttaaatcttaccttgaagttacaacaggtcaacgttagagtagacgtaaattccatgtgtcgaatgcgctgtaaactttttcacggaacattaaaaacaccgaatttgttcacgattatataagcatgaatttgcaattttaatagtcctataaagttttcatttcgatctaactacattttagtatttatgttccataatgtatcaaagtgtatacgttcaatctgtataagagtctgcatcaagcttcacgtgatttgtagttcgcggtttaatattcgctgttttgccgtgtatgagacttacatagtttgatccctaatacttctgacaggcgacgagcctttttatatgcattttacgacaaagtccacgcccttgtcgctgacgcaatacgtaaaggttttcggtttggatgagaatgtggttaaccgttaataaaaaagtcgatacggaaaaaagtcgaacggtatttttagatatcgggtcacatatcgatttaatatatttttatatcgtgtttgttgtccgacttagatatgtcgtttcatgggaaaaataaatcgttttagttgcgtgctgtggtttttggatcgcaaacgcttgagcccggaagtgtgattcgtgcgcataaaaggacgttggtaactgtgttcgctagctcatttgtgttagatgagcggcaaatgactcatctttctgggatttatatgggaatattctggtaaaagtgcatgtatcaattttagtcgtttttggatttctgtaatgttacgatttgctatgtgtattttcatgatgtcgagcatgtttattttattttttacacagataagatgtatgctgaagaacgtgcatatgggtcatttgacgatgttatggaagtttatcaacagattgttaccgagtctattcagctgaaaaggcttcatttcggcagtggctgtttaattgagttcttaggtgactctggaacgtgtgaaacattttgtggtggatggatatcaatgatttgttggacatccgatacaaattcaatgggttctctaacggtggatattgggatagatgatggaaaatataaaacgtacaatgctcggggttttttactgtgttcgaaatcgatcacgtcgatttctcagaatactgagggtagagataggattttgactgtttcccaagaaaacaacaaacttcaaataacgtttgttactctcactaaagttttcaaagagcatgatatacgaaatctgggcgatccgaaatgtatagaaaagtttgaaaaagaatgtcgagctttagatagaaaaaaacacgatgatgaacacagaaaacgctcggggaagcaaaaagaaaaaagaaaagtggaggacacggacaaaaaaaaagatgatgacagacgaaaacaagaagaaagaaaacgaaacgacgaagacaagcaaccggacaaaaaggaggaatcggatggtaaatataaatgtatagttgttgtaaatttttatttttcgtgtgtcacggtcgtggacttttttttaaatagtatctgttttgttgcaatttcagaacttcctaaggagaagagacagaagtaccatgacatgaaacgtaatttggaagaacaaagtcacgaggatggcataacactaacttctacgacactcgtaaatggagcggttgagggtgcgttaccgccctgtatttctattgataatcacgaagatcaacaacatgatgaattagacaagcgcgcttatgcgcaggtgggtggagtttcgggttcgccaaaacctaggtcttcggggtctttgttgtgcgtatctaaagctgatctttttattttaggggacgaaccgagaaggtctatccaatgaagataattatgggaattttcggcttaataagtctttagaacagcttagggccaaacttgttgcaagcagcggcgacattgtagaaagatcgcttttgaaattgaaagagtgtttggataatgtaaaggataatttaataaaaaatgaatgtgctgatgttactggtccaagtaaatgtttaagtaaaacaaaacatatcgagccaaagaaacagatagtgttttctgattgtgtcaggccggtacccgtgtgtgagattaaaccgtttatcgatgtgcgactatttgaaacggcgcggagcccaagaagacttcgacaacggaccaggacaatcgtcggatcaacagatggtgcgatcgagcaacagcgtgttatttcgggacaaaaccgaggcagagcacgaggacgtggccgagggagagctcccaggagacgaaattccaatataaataattcaaggacacaaactacaattgttatagacgatagcagcgaagccgaaaactttgaaaatgaggggagttttaatgaagatttactggcaaccacaatattggaaacactgtaaattttattgttgtattgtaattattaggtaaactgaataggttttattcgttcagaatgttccaattgattgggtctttcccgtgctccgtaagaaataaatttgctcgcacgaaatgattgcaaccaataaatggcatccttgcagacttcactttgggcgatggatgtgcactttctaagacgagatgtttccgtgcgtctattagataagagagtttccgggcatggtttccccacaataagaaaacgagagagtccatttctaccgatagtttgctgataatcttatagctcagtgtttgccagccaaatgcctcgtgagacattggtaatccatgaactacagtgaatatcgagtttagcaataggactccttcactacaccaggagtttaaacagccgttgtcagggggggaaaaattcggcacgcttctttccagttctttaaatatattctttagagattctggaatcgagcactctttcactgtaccgaaggccaagccgcaacctctgccgtcgggatacggatcttgtcccaaaatcacaacttttacattgtcgggtttgcataaaaaactccaagcgtggacgttatccgaagaggggtggaccattagatgagccctatcgttgtccaccaatttatatacatgtttaaggtgtgtaatttctaacttggagagttgcaggaaactcaaccagtctctgtttatgccgaagagtgaatgctgatcatctattgaaaggttttcacagtttttttcttcatcctgaacgtgatctaacatccactgtagtagggccatggtcggggaatgaaatgcagtggattaaattccctaggaggattttatgtgaatgggacgtgatgtcatagccaattatgtgtttctaatcagaattgtagggcgggaacttcggaaaggtagtttagaattgtaggtttccatatgttttagcaggtcgagctctactccggttttcaagtggaaatactttaaacaattcaaaatcgtatcaaaaagagtcaaagagttaaaagggaacctaataatttttgtgacgcctttagcaggattctccaagtataataaaaaaccaatgttgctgtaaaaactgtctgtgttttctgaaatgttaaactcgagacccgcaatgttatcaacaaaaaagttattgacgtacgtaattttttcgggcgaatattttctacagttatctctgatgcaggttgttattccgacggaaggtgaacatgtctggaagccattgaaaaagtttagccagttgtcccgagattctgggtcccttattagcgcaaacaatgtgcgtagttgttctgggttatcctgtaggagtaagaagtcgctgagaaattcatcggttaccattatacggctaaaaggctttttttttgtcgggggttgtagcagtattgacataacgtcttcattatatgccggaggctggtagattggttctagtaatagaggcacttcggatttcgtgcagtttattacagctgcgatacagtcgtcaagtttttcaaaatagaaagaattatggttgaaaagaggtattgcttttgagaaggttagtaatatgagtgacattacaaatagtaaaagttccatggttatttttttatttggaaaagttaacacgacgggaacaacatcttatatatagtagggaaaaagacttgtcgaaatgtccattcggctttttattggttttttatacggcatatattggtatggctatcggatttatatgtagttcccccgatgcggagctgttttccgaaaaatcacgtatgtcgtcttctgtcttgttaggatgtttgttgtgttgcatggattggtccgctgccgtacctgggaaaacagagccttttagaaaactttttgatgcaatcatgattaaaaagctaaaaagttgttctgctgcttacccgtctgatttggacgagggctcgatgtgtgatatggcagatgcatcgccgacaagtcttgaattaggattgtcgaaattagacaaagaatcatgaaagtattcgaagacattaatactggttttctttttcgttacgacgaacaatatagaagacgcaaagagaccaatttagattcgagccaaaaaagtttatttagtcagtttaatagtttgccataatcatcccaataaatatatttattgaaagagttgtatatggtgatgtgttcttgaaggagcatcggttgtgttagctttgcgatattcaaagtaatctcgttgggatagcagatcgcaaaattgatacaaacgtgagcggcgcataataaatccttttccgttggcgcgtttatcatgagagagcaaatgccgacaagctttttttttgaggcgtttaccggtataggagttacagcgttttttcggagtgcgtccgtttgtgggacggtccctctgaaaaactgattgattgcaatagcgactaccggttcatggtgaaccgattcagaaattatctgctcgcccacgttaataaccatgttgccgatggacatcaatttttcttgcatggcgtttattaagatcttatttcgggaataaacctgtatttgcacaattgaagcgttgtagcagcggaataatctgtaaatttctgacataaaatttttaggtgagcacggggagtaaggtggagatgtttcgtaagattgaaaaattttgaaagcgttgactgtattccgatcttgcctttggcattccgtagacctgacaatttcctttttctccgttgtcgatgtatttacaggcattttgaatgacaggtcggcgagaggtttgtccgtaaatacagtaagacgattaatttctttttcttggcgaaacacggcgtttgagattttccgtagtttggaataggcgtagatctcgttatttcgatatttttccttattaaattttatatcgtatggggtgtgctggggaaagactcttgcagtcgcataatcgacgggtttttcggttggggtggtttgcggagatagattgttttgtaatcgattatttcgtatagtcgttttagcggatagattttttttccgttctacgaactgtttcgttgtttttctagttcggcgagatttgacggtctgtcttgttttagaggtgtttttatttcctctgtctttcatctcttctgaacttaagctatataaattttaacttttaaatgcaacgatacacaccgaaatcagtagcactataactgatatcaatatcagaattaatggtacggtccaggtaaatacggtttcgtcagaatttgaactttttaccccttctttactgtattcgtcgtgattctgcacagtgtgttcgccggaagttacaagagcgctagccttttggttggtaaaccaactcgacgctagacatgagacggttttcccgacaaattccagcttcgttcgtcttttgaaagtaaagttcacactaacggttgacgatccgttctcattctgtctaactattggtatgtctctcttatatacttctccaagaaatttaataaccacatttggttttggataagacgtcacggtacacgtaacgtctaaaaaattgtctaagtaacgaaagtacaaaacgacgatgggtttcataaagagttttaagcaactagtcgcagacgttttctcgttatctactgtgaatgtacaggttaaacatgtcgcgtcatatgctgatttggctttaattttcaacagagatgtagttctattgtgttttatgtggaaatataatttactgtccacggcgagattgttgatcttatttagttcgtgtataaggacgtagccatcgtcagtgaacgataagttgtccatgttttgtacctcatgattcgatataagtcggtttttattgtaccacgagacgcttcggatgtttgtggttgtttcgaggcgacaatggaaagtgacaattgaccctatttcgtatattaaagaaggactcgtctccgggtggagtacaaaatgtgcacttatgatatatagaagcggcaataaccgaagcatcagagaactcatagtgtacgcttgtgtcaaatagcagtttctatgccaaatagcggtttctgatatatatataagtcacgcttaaaataaaaaaactcaaggatttccgttatactgttttatttttttttaaaaaaaagttgggagttaacattttgaaagtgtactaaatttcgatttaaactctttgctgataggattatagatggagataggattgtcaccgtcgatgattgaacacacccgaaggacaatttctttagggttatctttggcatacttattgcatgttttaacagctcctacaaagtcgatgggcgtagcggcgtaaattatcatagtctttacgtccgaatgtctcgtaaatagatcatgtgttgtgttgttttcaaatttatcccataattcttgcggtccttgtttttgtagttggataaatcgtttaatttcatctttgtcataatacttaggcggtgcatgattcattttaaatgcctctgaaacagtgatgttgggtcgaatcattaattctttttgcattatctttatgatttgagctactttttttgatcttgtaaagtacataatgatggctgcgttgttagagagcccattacagcagatgtcgtatacagcttcttttagatttttttcattgcaaggttttttggggatctgtttgtattcaaatgctctcatagtatttctaaatagtttttgaaaatcttttgtagccaccctcccgcggtgaattttaaatttttctgatacttttctttcttttagtctaacataatctctataacacaaatcgtcaggttcacttacttcagactctgttttctgcgctccggatattcttttcttgcagaaattttttatgctggaatctgaatcatcatcgcgggggcgtttttttttgcatttttttgtgttgtgtaatctgacattttgttttccctgtaggtgagaagtcgtgatattaggtgcctttttttgttcttcatcaatggcgttttcggaatgattggattgttcatgtgtgttaaatggactagaattgtgtaggggaaatttttcacctgcttccggggagtttttaaacacatctgcatgtctattcgattcgtaatctgaagacatgtttgtagttttgtgttttgaatctgatttagattttatttgtttattgtctttatattgagttttgcggcatgtttttaatgtggatttggaacatgataaagaagctgatgatgatgatgatgatgatgatgatctagttctggaagactgatagtaaaatggtgtaaacttctcttttccggttactatatgtgaattagatctgcaattttcttcaatactggaagagatgcttgatgatccagatttgtgtttttttcttcttacaacggtcagtgaatctggtgaatttcgacagtgagatttgcatctagacatagaactttctgaatcggtgtcattggtggattctgatttttttctgttggttcttatatgaggtctgaatcgggggttgtaaaattgatcattgtgattaaagcactggagtcgagctgcagtatttttgtagaaatttagatcttctccacatcgaaattttatttctgatatttcaaattttgtattaattgaggtgtcatgtggaggcgtttgtcttttattagaatcgcaataaatctgcctcagctccctgctggaagccctgctggaggctctgctggaggcttttcttgaggctttacttgaggccctgctagaatccctactggaggctctgctggaggctctgctagaatccctgctggaggctctgcttgaggctctgcttgaggccctgctagaattcctactggaggctctgctggaggcttcgcttgaggctttaccggaggctttgcttgaggccctgctggaagccctgctggaggctctgctggaggcttttcttgaggctttacttgaggccctgctagaatccctgctggaggctctgctggaggccctgctagaatccctgctagaatccctgctggaggctctgctagaatccctgctggaggctctgctggaggctttgcttgaggccctgctagaatccctgctggaggctctgctggaggctctgctggaggctctgctggaggctttgcttgaggccctgctggaggctctactggaggctctgctagaatccctgctggaggctctgctggaggctctgctagaatccctgctggaggctctgctggaggctctgcttgatccctgctagaatccctgctggaggctctgcttgaggctctgctgggagcccttttagaagccatggtgcaacttttactcagatgtttatcagagtttttgccacaagttcggttaggatctttagattcatttttggtggaattgcagttaggtttcctgtcagtacactcatcactgttagaagtgctatccgtgatgcttttgttactgttggatttgttaaaagcagtaggatttaaattactccgaataggtgaattgtctgttaaatttttgtcggcgcttgcagtgtggtttttagcactgttcttgtccataattgaaggattttttaacttgcaatatggagaaggtgattggataatagtttttaccggagatttgtattgaccttcttcatcagagctactggaataatggtgtgtttttgattttggtgatgtagatgtggctttccctgaaacattcttaacggatacttccttaaagttttggtgtccgttggagtttgtagtattttttttagatgttgtacgtccaggagaatgtttcattttaggataattgtctttggagtcatgatgttttttgtaagaattatctttggtcggggctcttggagtatgttttgatatgggaactgtgtcttgtagagaagtttttgatcggtgtagattttgttgtatttggttgaattctggtgtcgaatagaatttatctgtatggtccgcaaagtctatggcgggttcaggtgtcaacggaagaggagataatagggggtttaattttgaaaaatctctagctttagtaacggctttatcttcattctcattagattttctctccttaagatcagaacgtgatgaggcatggttttcatcatgtttgtttgtttgagaactgcgttcttttttcttctggactgatctacaacggatatgtgcttttttgtacttctgaatatccacgtcacgatttgagccattggctgttaaggcttccttcggtaacggaataacgtcagtgtcatatatttttttaataatatccattttgtaggaactaggtctgtatgataaactgattacgtcaggcgttaaaacttgattttctgtggatgtttcgttatccttagtagcctcatgttttttagtttttgtagtttctggtattgtctgtgcttttgttggatgattgtaattgtcggattgtacgtgtgtggagtctgttgagaatgccatgctatagtcataggattcaaaattgaacttgtttgttagttgtgtaaaatctttatagttattcatacgggggtctggattctgttgttcgtagtttggatacgtgtaatgttcatatggtaaatccgcggatctgtctgagcaatcgtatgatctgtggcctcttccgcgtctgttataagttctggtaaaacatcttttgtatggctgttgatactttgagtttggattgtagtaattatattttccatttcctcctctgggcctatacggatgatgtctaaagttatagtcatatcctctattggtatttctagattctctgtaggaactctctatatctctgtatggatcatgataaggttgatacggcaacgaggtgaaattgttctgtagatttgcattttggttatgtgacgtgtacatgggctgtaggagttgattcggtagttccgaagcaaagcgcacctgggtcgaaccgctttcgtttgattgtagattggaagcagaggatgtgcattgtctgtgggtctgagctactagtggatcctggatagtttttgaaaatattctggattcttgagaatatataggatcttgatgcgtattatcactcaacggttgtgtgtgtgtgatgtccgcatcacagtatagtccggataatttcatggcgctttgaatgacgtcgttatcatttccttgtttgcatttttgttctggaaaacatgtttataaaattgaagcttaatagacagtatttgcttaatgtatttaataaattacggataatcattttcattatgatacagtccgtgcagaggatgatgttcataccgattgtgcgtggtgtgcaaatgaagacgttatagtttgtagtaaaaattcactaaatcgaattactaacaatgggggggattatttatataacaatagtatattaggtgtcatatattaatttcatttaaaactaggatggacaatgacataagttatatatgaaacccggtgaagttaatgacaattgaattggatggtctattaatttatttttaaatatttgcattagattatattataataaaattgttttaatattaaaaatttaaatgattgatgtattcattattgacatgcagtaaatccagtatattgggtaaaagtgagatttattagtcggggggcgggcgtatgtataatattcatgtttttaatatatggtatttatcaattatctacttgtctaattgtgttggttgtgtgcaagaaacccgtggatatattaacgaataattgaaattgaattgagtgaagtttgtgactatcaaagggttaatatgcataatcaaataaatactgatgctaccacggggatggatataatttgataattagaatacaattatttattatgtattatggagataacataatttaaagtttatagtagactagtttcattatgtttctaatgtgatagcgccctctgctgttgaggtaaattatatgatattgagcattttaagtatagtagtttgaatatgtttctgatgtgatagcaccctccgttgttcaggtgaaagattaatagtggtaaatagacatttttaaagtactttaaacctaataatttgatctattgtgctttttgtgtatgtctctatgtatgtctctgtgtctgtgcacgtgtctgtgcacgtgtctgtgcgtgtgtctgtgcgtgtgtctgtgtgtgtgtctgtgcgtgtgtctgtgcacgtatctgtgcgtgtgtctgtgtctgtgcgtgtgtctgtgcgtgtgtctgtgtctgtgcgtgtgtctgtgcgcgtgtctgtgtctgtgcacgtgtctgtgcgcgtgtctgtgcgcgtgtctgtgtctgtgcgcgtgtctgtctgtgcacgtgtctgtgcgcgtgtctgtgtctgtgcgcgtgtctgtgtctgtgcgcgtgtctgtgtctgtgcgcgtgtctgtgtctgtgcgcgtgtctgtgcgcgtgtctgtgtatgtgcgtgtgtctgtgtatgtgcatgtctctgtgtatgtgcatgtctctgtgtatgtgcatgtctctgtgtatgtgcatgtctctgtgtatgtgcatgtctctgtgtatgtgcatgtctctgtgtatgtgcatgtctctgtgtatgtgcatgtctctgtgtatgtgtatgtgtatgtctctgtgtatgtgtatgtctctgtgtatgtgtatgtctctgtgtatgtgtatgtctctgtgtatgtgtatgtctctgtgtatgtgtatgtctctgtgtatgtgtatgtctctgtgtatgtgtatgtctctgtgtatgtgtatgtctctgtgtatgtgtatgtctctgtgtatgtgtatgtgtatgtgtatgtgtatgtgtatgtgtatgtgtatgtgtatgtgtatgtgtatgtgtatgtctctgtgtatgtgtatgtctctgtgtatgtctctgtgtatgtctctgtgtatgtgtatgtgtatgtgtatgtctctgtgtatgtctctgtgtatgtctctgtgtatgtgtatgtgtatgtgtatgtctcttgtgtatgtctctgtgtatgtgtatgtgtatgtgtatgtgtatgtgtatgtgtatgtgtatgtgtatgtctctgtgtatgtctctgtgtatgtgtatgtgtatgtgtatgtgtatgtgtatgtgtatatgtatgtgtatgtgtatatgtatatgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtatgtgtataatagagggaaacaaatagagagatagaggatagagagatagatatggggggggggatataaatatggtaattttcaatctgtgtttccaaaattgggaatcatgtgtagcatcttaccttcaaagtgattccagttaataagatgttgcaataaaaaatggatttggtattttagatatatactttcaagtgtttggtgtgacattcaaagtctaatggttgaaaatgtttttcataaatggtagctattatgtgaatgttaagcaaaaacagattaaatatacctgaaagaaaaatattttgtagagtgttatgatctagctatagctaatgtaatatattttttaacagtactatgatttatagaattaagatgtctcgggggcattagtcttaatcaactggtttagtttggggaagtgaaagtaaaaatctgaatacttgacatctgtataaggtttttcaagaatacaattgtttatagtatcacgtctctaagaaagctggaattaacttatggaaatattatatgatgacttataagtcagttgatgtacatgtcttggaattaaaaagagaaagcaatgtctatattactttttattatttgtaaggtgatattgaaaataaattcatttgaggaatcacgtgtttgttgatgtattacataatacaaaaagttacatttgcttatgtaatttctaatctatagcaacaaaaagagttacacaatatggggaaagtctatattttacaacagtataagcatatttacataatacacatctgtatgctaatgattgctaatcaatttacatctaggtttcatctagctaatagatttgagcattttctacgaaaggatcataatcagaagggtagccatctaatttaaaggcctctgtaccatcactgttgcaatcacttatattggtacatttttcattagaattacttgtaccttcagtgcatctgttttcatcattttgacttgttgtgtcattgataatatttagtatggaggaattatttcctgttaccggtgggtcaaacacttgagttgcggttgttgcaaaagtttgggaatttgtcatatttaaatcgtcctcacatgtagtaggggtgacaacattatatttattgcaaagatcctggcaatgtttggttatgccctgtttaatgatatcatttagatccataaaattatccatcaccatatctatgataagtttcttagttggtattatgtctcccgagtctattttgctattctgtattttattataaatatatgagacattgttcttatcatagtcttcatcatccgttttgatggggacaaagtgattcataaagcagtgtttggcttctgtcccatcactgtcatcttttgcatccacattttcagaattgtgaataggacaattgtctacttggtgagttttcttcatataccaaatccaattttttttgggaataaatttggatttgataccaccggtaccctgcattgaccttattgggatggtaaacactggagttggaaaaccataacttggacaatgaccattattggtaacttcatcataatcactcaaatgtaactgtttatgttcagatgtacagtcatttgactcgctgctcgattcagaatctgattctgatttaatagcttttattaagattgagttaccaataatattgtcaccatcctcttcatcttcactctctgaacttataacaattacgtctgcagccttaggtaactgatctgtcttaatctttttatttttgggtgatttacttgaaacatgtttccttttagctaccctctttttaggtttgcttcccggagtcatagacttaggtttgacatttttcttagaaggggtgacctctggtggtgaacatatagaattgctaaatggtgtattctcatcagtgctattcatatgaatgttattagttctcgcagctgaatcagagtttgcaatgtaatcaatttcatcattgttatcgctttcactctcatagggtgccgagtgatcagtttcataaccaaacatcatcatttctgatattaaagtgttgccataggaaccatcttgttctgtcccttcaactactgaatcgcattgagtgtcaagtagtctttctagcaacatgtttttacaactctggaggccgctgatggagttcaagttatcagggccgcccagatctgtcactgaggctgtacctacacagttagggtttgtttgttcgtcccctgactgtctgctgttttcagtgaatgttcctacatatttggatttccctggcacttctggagaaggagtgcatggatacattttattgtcatcatcttcatggatagattcgatagaagattcctctgaatatcttccatggtcatcaaaatcagctaagtctaatatcattgagtctgatgggtctgtgtttccatcacagatggaagactgtctatttttattcatattaatgtagccgtccattatttgaaggggagttaaaggtttaattaaaccagtatcatcataatctgattctaagcattcacatgcctgggtaatcatattcagcatggtaactttaaatccccgtctcagaagtttgaggtgttgccatgaaaattcattgctgcatataacaatactctggagaatagtattggcaagatttttggcggcagtaattaaatttttacaattcacattaagtttaaggaatgctttatcacaaccatccatgaagatttgattcatctgctttatagcaaatgtctgtaaaatttgcatatttttagcatttgtttctactatctcatttttaccttccagtaatgtctgtttaagtgtatttattttttcacaaaagtccttactggagatgtcaggattggacatctctttgttgtgtgccatcatcatcaacatggtggcgccctggttaagtttctgacaatctaatgtcacagtagctttagaaaaaatgtctttgacggccttaataatgtcattgttcatattagctctcaaatccaggagcaagtttctggattctgatgccacctttttcactaacccatcgaatttatcacatgcaaaaacaatgaatctaggttcgcaccaattaaaaaaatccaactcttttccatgcaacatttttgaataagattcaacatatttagttgaagcactacttaataaattaatgtttatcaactgtgataattgttctaatcctagtcctatgaacatggattgttgctgcgttaataagccagcgcacttaattaatttgtcttccatgtcagactgttcctgtttcatggcagccttcactgatgcaccaatactttggatgcaattcccagcggactgagctaggatgtaaaagaagatattctgagtatgttatatgtcacatgtttaaaactatgttttttcttgttttctatcttgggacatataatataattcatgtacttaccagctaaagttttcaactctccatctgatccttcttctacattattggactctatgttgttggaagactctggtataataagaccaaagctttcaaggcctggaataatcaggtcatcgaaggatgtatcacacatgagactctcttccaatatttctttgatagattcttccatcattggatcgggacggtagctgtaagtataaatattttttaagtacttagaaaaattcccaaataatcttaaataagatagatctaataatgactaatcatacttactcttgcatacgttcatcattggatcccatgttgtttccagagggttttgctggctccattgtatattaagatgcaaattgagacaccgcctactgtgctgatagccaatgaaaaaatatctcccgtcagcacatataatactatataaggacattaccaccacctctttctttgcagagattctctgcttgcacatctgtaacactgaccataatggggaaaaaatcatctactggaactggaaaaactaatctaaagatactggcatgtctactattgatatttctaatggcaacaatatttttgctaatactggaaattatatcgggccaaagatattccaatgatgattccgaaggtgtgactgcggcgctgaagcatgtaagcacacctactaccaactgcactgaaaccactactcctggttagtgaaggatatgtcttttttattttaatgtattgattatatatttgcatacattccttaagaatgaaaaaaaaaatatcacggatggtttgtttttagattccgtaacgagccaagccatggaaaacaaagaatcaatgaaaaaaaatgaaggggaacctccagtttggattcaggctttaactacaacattatcaattatcctattggtttgcataataatggcatgcattatatgttcccggaccacggaagaagagaagagcgaaatgcaatcttctgcttcttcagtagagactttacagtctttaaatgaggctatttttccgaaaggtgaaatgaatgtgtaatgtctgtatttttctttgcagagatgtatggagagcttatattgggggaaaatacctgactgttctgcctatattcgaatgttgaagtatgtacaatataatttcttaccttttaagagtgattcaaggtggaggtttctttggagatgattccaagtggtggttttgggcgcaatcaatcttctgggtgggaagaaaatccagcaatgtaataattgatgggatgcaatcgatgtgacaaatctgtaagattaaatgtgaacattataaattattttgtgattaacaaattacaatcatgtgcatgaaaatatcattaaattgttttacaaattttaaatgcaatttaaaagaatttttgtagcaatcttaaatattaatcgttacaaaattgacttaccagactgcaacgatataagaaagaatgtctgtgatgagaatgttctccggagccacttcttgagaatagtggcactgaactggctgtaacttctgcttatatacaattctgtagcgggtgtgatgtacaggaaaatgacgaagatgaaggaaccaatcgctgcataacgttaaaccgcaagtgcagaaatacaccccttttagacaaatatggaattgaaattagttaatgcttgcaaaaatttagggttttgttatattttacaaaaacaggaatttgtggtctggattttttgaggttttttataataaacaacattttactgataaattgtcatgttttttctaagaacatctgttacacatcataagacatgtggttttggtgttagcgtttctcaataaataaatgactcagtcagaggaaaatgttgcaatcgcggtccccactaacctttaattttatgagaaaaacaggaactgcggttgccccgttagcaaattttagggttcttgttagcttgggcaggaaagaccccaaccgcgatacccactgacctttaattttccgagaaaaacaggaactgcggttgccgcgttacgagattttagagttctcgtttgcctgggcaggaaatattttccgagaaaaacaggaactgcggttgccgcgttacgagatgttagagttctcgttcgcctgggcaggaaacacctcaaccgcggtacccactgacctttatttttctgagaagaacaggaactgcggttgccgcgttagcagatgttagagttctcgttcgcctgggtaggaaacacctcaaccgcggtacccactgacctttaattttccgagaaaaacagaaactgcggttgccgcgttagcagcttttagagttctcgttcgcctgtgcaggaaagaccccaaccgcggtacccactgatctttatctttatgaagaaaaacaggaactgcggttgccgcgttagcagcttttagagttctcgttcgcctgtgcaggaaagaccccaaaccgcggtacccactgacttttagttttccgagaaaaacagaaactgcggttgccgcgttagcagcttttagagttttcgttcgcctgtgcaggaaagaccccaaaccgcggtacccactgacttttaattttccgagaaaaacagaaactgcggttgccgcgttagcagcttttagagttctcgttcgcctgtgcaggaaagacccccaaaccgcggtacccactgacttttaattttccgagaaaaacagaaactgcggttgccgcgttagcagcttttagagttctcgttcgcctgtgcaggaaagacccccaaaccgcgatacccactgacctttatttttccgagaaaaacaggaactgcggttgccgcgttagcagcttttagagttctcgttcgcctgtgcaggaaagaccccaaccgcggtacccactgatctttatctttatgaagaaaaacaggaactgcggttgccgcgttagcagcttttagagttctcgttcgcctgtgcaggaaagaccccaaaccgcggtacccactgacttttagttttccgagaaaaacagaaactgcggttgccgcgttagcagcttttagagttttcgttcgcctgtgcaggaaagaccccaaaccgcggtacccactgacttttaattttccgagaaaaacagaaactgcggttgccccgttagcagattttagagttctcgttcgcctgggcaggaaagaccccaaccgcggtacccactgatctttatctttatgaagaaaaacaggaactgcggttgccccgttagcagattttagagttctcgttcgcctgggcaggaaagacccccaaaccgcggtacccactgacctttatttttccgagaaaaacagcaactgcggttgccccgttagcagattttagagttctcgttcgcctgggcaggaaagaccccaaccgcggtacccactgatctttatctttatgaagaaaaacaggaactgcggttgtcgcgttagcagcttttagagttttcattcgcctgtgcaggaaagaccccaaccgcggtacccactgacttttaattttccgagaaaaacagaaactgcggttgccccgttagcagattttagagttctcgttcgcctgggcaggaaagaccccaaccgcggtacccactgatctttatctttatgaagaaaaacaggaactgcggttgccccgttagcagattttagagttctcgttcgcctgggcaggaaagacccccaaaccgcggtacccactgacctttatttttccgagaaaaacagcaactgcggttgccccgttagcagattttagagttctcgttcgcctgggcaggaaagaccccaaccgcggtacccactgatctttatctttatgaagaaaaacaggaactgcggttgccccgttagcagattttagagttctcattcgcctgggcaggaaagaccccaaccgcggtacccactgacctttaattttccgagaaaaacagaaattgcggttgccgcgttagcagcttttagagttttcattcgcctgtgcaggaaagaccccaaccgcggtacccactgacttttaattttccgagaaaaacagaaactgcggttgccccgttagcagattttagagttctcgttcgcctgggcaggaaagaccccaaccgcggtacccactgatctttatctttatgaagaaaaacaggaactgcggttgccccgttagcagattttagagttctcattcgcctgggcaggaaagacccccaaaccgcggtacccactgacctttatttttccgagaaaaacagcaactgcggttgccccgttagcagattttagagttctcgttcgcctgggcaggaaagaccccaaccgcggtacccactgatctttatctttatgaagaaaaacaggaactgcggttgccccgttagcagattttagagttctcattcgcctgggcaggaaagaccccaaccgcggtacccactgacctttaattttccgagaaaaacagaaattgcggttgccgcgttagcagcttttagagttttcattcgcctgtgcaggaaagaccccaaccgcggtacccactgacttttaattttccgagaaaaacagaaactgcggttgccccgttagcagattttagagttctcgttcgcctgggcaggaaagaccccaaccgcggtacccactgatctttatctttatgaagaaaaacaggaactgcggttgccccgttagcagattttagagttctcattcgcctgggcaggaaagacccccaaaccgcggtacccactgacctttatttttccgagaaaaacagcaactgcggttgccccgttagcagattttagagttctcgttcgcctgggcaggaaagaccccaaccgcggtacccactgatctttatctttatgaagaaaaacaggaactgcggttgccccgttagcagattttagagttctcattcgcctgggcaggaaagaccccaaccgcggtacccactgacctttaattttccgagaaaaacagaaattgcggttgccgcgttagcagcttttagagttttcattcgcctgtgcaggaaagaccccaaccgcggtacccactgatctttatctttatgaagaaaaacaggaactgcggttgccccgttagcaatttttaaggttctaacccgcttgggtaggaaagaccctaaccacaacacccactgacctttaactttatggaaaaacaaattattttgctcaccatgcagttttttatatatcgttatatctctacccaatcagcacccttgatgatgcatacattaagggaatgttgatttttttttcattgtacccacttacgaataacgaatcagaagccagaaagtagaatattttaatgatgtattactcatcatttcctaccacacctattaacttcagtatttataggagaggcatttttccgttatgcgccattagctgttcttctgctaactcggacgcagcggtacagggtgagttatcagtgtcttataatgtgatgtcttttttttattttcttgtcggtattttaaaagtggtcttttaagatgttgttaaatatatagttataaaattttcggaaccgtgtagtcaataaaacaatttatagaacggttcctggcccaaaacagaaattgatttatgtcgtctttctgaattacaggaaaattgcgagggatgactttatcaaatgtaaaattatataccctctgtgatagatttattttgtggagattggaatgtaccatcgagcgtatatcaacgcaagatgtggctatgatgggacacggtcctatctgtacatggtcgttttcattaatcggaaatattattttttgacctccaaggagggattttataatattaaaattgtcaaagttgatacttatgtctttccaccacaagactaaaacctgtccgtaagctcttaaattttttgtattcagagatccatgtaatattccatgtaacgggatgttttcaagaatggctcccgttaacatcgattttccacatccgggtggaccgataaaactaacggtgtttttttttcctcctctgtggcttagccactgatataatatggttcctgctaatatagggtcaaaagactgcagacagaacagctggtaaaccgggttttcataaatctgaaagtcagtgtctatgtgcgctataaaatcgatagctttcctagttgctcttattctttttttagctatagatagagccctatggattagcacgtccccgtgtgttagcgtcaacaattgcatgtatgatctaatgtctcttcgtatccacgcgtcttccgtgactattccgagatcagacagccattcgatggttcccagaaatttagattttaaagatatcccgttaatcccatcctttggaaacagcataagtttgacattaggttttttattaaaatgggatatgatgtgttttcgatgtatctcatcgcatacgtctcccagttcgttaatatttgtccacgcccattggaactgtggtctaataatttgaagaagggcaaaggggatgtaacttagactgaagacctgggttccgccaccattcttctttgttttggcatacgtgcaccaatcatctattttaggggcgttcccgtcgaagaaatctttaattaatacgcccctgatttccgttgtgtgttttcctatcgttgcgctgggaattccatctaaagctatcaataatattagggagggtctgccagctttattctccgcttgagcgtaccactttgcaggggtggggacggcagttttattattccagtaattgagtatgacatcgatcattttggtacatgcagttatccatttaatatcgggcgctcccggtgagtgcatatccctgaaatgtggcacggacacgttagagaatttacagaaaaaatccgtagatattccagggatttctgcctcccactccatggggcctttgatagtcaacatgatatatttgtccttagtccagaaatcatcactcggatttattatggaaaacataccgtttgcgcctcccaagttttttatagttgtatacggaaaataaggtaattcccctggcttgtcacctctagatgtctgcacatccggacgatttgttttggcaacaaattctcaatatggatccgacggaacttttgtcggacgatgtaatctcgtccacgtgtgacgaaaacactgcagctggaactgatattatgcagcctttgtgcgttgatatgtctgttcaaccgacgacatcggggtgtcataccggagcgatgatgtcagactcgtatttctccaatgacacaccggatcaaaactgccaatcgcattcgactttgacggacctttcgccggaagacatgaacaatcaaatcaatgttcaacccaatcagatgacctttcaacccatttccccaccgatacaggatcaaaattatggctatagcaataatatgattaatcccatcaaacctgcatcaattatcaaattacatggtcattcgataggagaaatgacagttacagacccttcctctcatgttaatgctcaacactttgtccaacagtctaatcctaaattctttctaaatatgtatccgtgcatgaccgctaactcacaaggacccggagaatgtcagtctgtccataatcaatcttctggaagcgggtctaattcttatgacattaatacggcaccccgcgatgaatggatattcactacatccggcggagaatcctgggttctgaaacggaacacccctaatcctccaaatagcagaactaatttaattttcaacaacgcacaaccgattttccatacccaacctcaagtatctgggtttagcgactgttcctatcaggggggtggtctcaattcacgtgagtatgtaaatttggcaggttacactcccgtgtgcaacatgcagaatatcaaaaactcatgggcgacacaactaggagcatccattgactgcatgactgcgtcaccaactggtatagatgcgaatgtcaactctgctttccagccggtgggggtggtatcaaataatcggggtgctaatgtttcaatgggaggcatgggtaattatatagagaataacagtccatggaaccaatactataaatcggaaatggctaataattccataaatgtcaaggagtcgaatgtttatggccatgtggggtgtgttaatgacgccatttccgataaacaaggtggcaccgctaacgtcccatcttctctattgaatccggatcaccaagattggatgaggatgactggtacgaacacacatatgttaaacaatataaatactaacacagaaatggaaaactatgattttccggaaaatgatggcaatgtccacggagccaccggtgtagatttatcaaccctgtccaatggtcagcagcatagcgcatttgaaggaaatggaacatttcccgtggtaaacaccggcaatccaagaacgacgttgaactgtgctcctcagttgttcttgcttggaggaaacccgacaattgcacatccaatgaatgggaataatgaaaccccagataaaaatgtatgcaagcctacccccagcacaggtgtaataaaaaaattaaactttgacggtgttgaccgagggggaggaataggaaattttcccaaactggcgtcttttgtagctatgagagaaaaaatgtcaaacacggtcaatccttcttgtggaacttttctagaacagttggagggattacgccagcagaattcatttgaaaaaaatatatcctttgctgatctacatttttctgaagaagatgatgtgctttccagtgcatcctcggtcagctgtaatagcaactgcgacatgaaaatcgaagtttcgcagcaaggtatcactgtgtctaatttacaacaaggatttaggcaacaaatgaacatgaactcatccgtggttaaaatggacgggagctataaaacacaagagatgtcaaatggctgcgcgacagacgtcacggataatgcaggcaccattcaacaaaataaacgtatacactctcaaaatgagaatccagaggatggccaggtacgggagggagggtgttcagacgtcagaaatgaacctccgcggaaaagtgcgcgtattcataacatgaagtccgaaggcgtgacttgcggtatgtgcatgacggctgcggattccacacggcaggatgcgtctggaggttcgagcagcggaaccaagaatgaatattacgatgatgaatcggaattaaccggattgtcggatacagacagcgacaacgaagtccaatgctgtcaagaagtaacaaaggtcggccccaagacgtactcctcagaaaactttaatcctgagtatcgccaagccaagagattgcttgccgacattccatacagaagatggattccagacccagtcaatatggaagacaacgacggtccgttcattccaatagtgactagaccagccactgtgtgtatgaacggtagacgccggaggactttcttccggcaatgtgttaccgctttcggtcctctgagtaagttaacttatttcaaagaattactgcagagctacgtgtccaaaaataacaatagttatttaagtatcagttggcctcccaaacacggggtatatgtcatgtcagagaagaaattagggtatgaacatatacctaccttgaaggacaagtttccactgccatgtgggtggatgatggtccttggagttgtcggtgcagaaccgcccgcggctctgaataaaaacatggtgattctcctgtgtgaaaatagatgggtgcttctgcataattactcaaactctacacacgagctgtttttagccgcctcggatttgaaacagtttatggaggagggtctgtctagatgtgatcctatatatgaagaatcaacagtgccgtacggtgtggccatggaaaactctcttcgagatttcttgagaaacagtagaacgtttcaggatcttatggatcaaagggacaacatgcacggatgtaactggacctttaacggaatgcctggtagactaggtgacagagtcatacatctctgcaatcctgaatcggttgattccataccaggagacgaggccgtcgtatgtgaaggaagacccttgtatttctttgcatatgttaccactttcaaatcaaaccccgctactaaggctaccgtgttaatagccgcggataaagatttaagaatatatggctatcataaaggtcgccccaggatacggtacttgtgtaagaacgtaaaaactttctttaaagccggggctagaaagttctatttagattttcagattacacctaaaaggttgcttgccgtcaacgaagaggagtatctgaatactctacaaaacgctccttgtctgctcttaaaaccatctgtgtttagaaatatttactctcaggaaggtaaataagaattcctatgtcaatagttttacttcacagtccccaccctctttttttaattaaaacagaaaggccgttggatccaatctaccgagagatttactgtttctttgacatttattagggatacgtatattgtgtaccttgtaatttctatgtaaacttctgctattttttttaatgttgagtaattgaacattgtaaataggtaaactgttttttcaaaatggttagaaattctatgtacttatttttttttctgtgtattgtaaaagggaagatttgtaaggacaaagttcagtaacatttaataaagaacatgtgacacgatttctgactctctcagtaatttgtgtaatttaataagagccaataccaacgtgagggaaacgtaggttccggccaaggtgaggaaaacggaggttcctgccaaggtgagggcaacgtagcttccgagggataaaaaagtaattcgttactatgagtagtcggataaaacatttgtagttttttgtctaacacataataattatcttgataacattcatgtcggaataaatccgatataaacgtttccatctgtagatatcttggcccgttttccatctgtagatatcttggcccgtttttgcgtgccaacatagcacttttggttaaattgtttatcacatctcttccgtagtcacttaaaaaaaaaacaaaaaagacatgaaatgttatagtcggcctacctgcaatttatataagtacaaataaacacagtaaaaataaaatgattcacatatggattaatacctaatgactagattgaaatccatccacgttacggacaagggtttttgaacttggtcttgcatggtatatacaattgttctattgtccgtgagaggtcgacaaaacttctggccttcattttgaaacagactgaacaaatatcaagttataaattaaccggcgatgtcctgtgttattactcagactatacatccacatgcacacacgataaaatggtatagtaatcattcaggtttacccgaggtgacgttttccccgagtaaatcgaacgatacttacatttcaccgtctaggcaggtcgaaatcaaggaagagacagaagtcgatgagttaagaacgacatagctatcacagcacgaagtaatcttcggtaacgtgctaaaaagcggtagcgcagccattccacgatatgcatggaaatgtattaaaatatacacaaccaagaaatgcataattatctagcagcaatatagtttgttattcaaacaatgattcttttatcttcatttaaatataatatgaatatttacagctatatatacaattcaatatacacatggtcgataacgcactatttatatattccaaaaaacaacaaaagttatcgggggttatatttatctacatcgataaagtgtacaaatgtatatgtaaacacaacaggaaaatatacatgtcccaaggcgtatacattctaacacgcgcacataacggtcaggtcctcacgacagtaggttttatatttatcattttgatgttttcagattttacttctttcggattgtaaaatacgtgcccaccctgacataaagcttgtccgaggtgtttatatacatattcttttctttcgaacatattttgtgtagtatatctcccttggactgtgaagatgttgttaaccatcaataatcccgcatttctaaaacgttgttttgaagttccggtctgtacaaatatggtgctgcaaattaagaaaaactgcataaatataaaaaaaatccggaaaagtcatttatttaattacgatcttttgtaaacagcgctcaccataatgcgggacgcatgtgtgtcggactggctatatcgtattttatattagtcgttgtcaggttttctggcaaagagtgccacaatgcgcttacgatggcaggatctatgtcgctgtgcataaccggaaaatcggaaaaaaaattaacataaaagattactccaaaaaatttgttcctaccaatcccctgttatttaaactcaccgtatagttgttccttgctgtccgaccattgacaatatttgtgaggcaagtcgcattgcgatggtttccatcagttcctcagtttcaaacagtgcatttctaaaccctctgttagaaacataagttaaagaatctcaaacgatacatcgcacacagtataaattcaaacttgcattaaaaaaaagagaaaatgagcttacttacagtacggaagataaataattcttcgtctcgtttttatttaaacgtgaacaccattcgaaaccttgcagtgtttcaaacctgacaaaaaacgaaattcaaaattacaattttagaattgtgttccacctgtatgtggcaaagctaataagaaacataaatgttgcttttttagtaaaattgactgaaattacttacacgacgtagctatcgtttggacaatgggtatcgtttataggcacgtatacgtcaacgatatcttgccacggttcgaaatattgagtctgagtccatgagttagaagattctaacgtacgacgaccatgctgcacgtctcggtgacgacaacacgtatcattagcgacacgtttatacctcaatatgtcctctatattaacgggcgcaaagcgcgtgcaggtttcccaatcttgcccgtcgttgtcttttcgaacgatcgcaaacgaggttaacgtcttcatagtctgtccgccattgtttcgtattttcaaaatctcgatactgacgatcagttcacttgagtgaataaatacatgtgtgccccacggagaggcaagacatggggaacgagaaaaaattttatgattacgaaggcttccagccccatagtttctactctgaaaggatgtaggtatgcgtgcggggttgatacgtatgcgcgtacaggggtgtggtctgtcttctaagggggggggggggggggtagagtggagagtgtaagacaagtagtgcaacgtttctagagtaacaggtgcatccgaagacgcggcagggtgtatagatgggactctttttagtaaactcggggtgtttatgtatctgggatgttacacttttttaggtcgataaatacaaaatgcatgtctttccttggcaataaaggagacgtgatacaaaggcacacaaacttgtacaggtactcaccatagagtctctttcactttgtagttttggcgtagctctaatttagtagtcattggacagaaacgtatcgccgtcatcgcggtcagtggtttcaagcgcctcatataggccaaactattatagttgctcccgaaagcgccataaagcagagacaggtgaaggcctaggctactagagagaatttgcgatagacccttaggcattattctatctttaaaatttctcactcctttgttgtcagccgagagaggaacgcagattatgatatctccgaacatgatgctgcgataaattaaatatgattattatctattcatttatttatgatctcagtagattccgacatcgaataaacaagatgaaatgaaacgctgcatccttaccgtgcttgtgtctctatggtacaaccgcagctattgtcatcgcaaacagcgtagttcaggatgtctgctatatcttctaaggtagtagtcgggttttcatctacgggaacgaaagctttaactctttttaaacttaacatttcggaggtagaaaatttagaaatgatttccgatagcgtccgtctcctcggcgtagaatttctaccttcgtaaatgttaaaataaatgtctttgtcatagtattttgcggtatagctatgtttatcctctggaggcggtgtggatttcacggttcccgcacgtcggtgggccgtagcgttcgttggggccgtcgccatcgaaaacgcgcacaaaaatatcagcgcacaagatctcggcggtttcatagcgctcagccttgcggttgccattcttcgtctcagtcttgtgaaaatttcgtatgcgcgagacaaacaggacaaggagtaaaggaagatgatgttaaatagactatagacgagaacaaacgcgaaacagatcctatgacgacggcagacaataattaaacggttcgcgtcggggaacattcgcgtgaatcaaaagccatgacaaattaatgcaactagagagtgcacaaaaattatatatggctaccgacaacgtcgggcgcgttcagagtcctgtaccgtgtgcgactgagacacgtagtgttcaaactctaccttctaaaatcacacctcggtggaaagatcgtgcggcgtatcgttgtcgaacagcggactcgaagatgagtcggggccgatcatgttcatctgcggcaatataaagcggagagggaggcggtataaaacgatagcgaagaaaaatacatctgatcgccaaatggcgatcagtactctgacgctcatcttttccgtaaccggcgtgtgtgtagactgtcgttttggtggtcagatattaagtctgcgtaattctttcctctctttttatctctttctctctattctgctatcttcctctgtctgtttatgaccgcgcccgttgcagcacttatcacacaacgcgcgcaccggcgcgcgtttacccgtttctccggcctctcctactcacctctgaggcactcaacggcactccggccgggtcacttgttctcataaaagcggtctatctccactccgctcagccggaccgtacccggaccggaacagttatcgccatatagctgccgtttttctgcagcggcgagtcggagtgcgctcgggccgagactccttttttgtttcgttttcctatatcatcgtcgccccgcggcgcgaggtcagaccgcgccagggccgggacacttttttgtccaacaccgtttctccgggagacggaatacctcgcgttttaaaaattacgtcaaatcccccgggggggctaaaaaaagggggggtaataaccctaaccctaaccctagggctagccctaaccctaaccctaaccctaggtctagccctaaccctaaccctaaccctaggtctagccctaaccctaaccctaggtctagccctaaccaaaacattaaccctaaccaaaacatcaaccctaactctaacaccaacgataacactaaccataaaactatccctaacactaaacctagccctagccaaagtactaaccctaaccgtagccaaagtactaaccctagccatacccctagtcataaccctagccataaccgcataactctgttcacaaccctaacactaatcctcgcatccgcacctaacgctgcccctctttcacaccatcaccccctgccgcttcaacttcaccttcttcctccatctcgccccgcttgtttctacacttgtccgcccctctattcttactctaggatgccgctaacggtgcgtgccgggcacgcgccatatcgtcttccgctctccaattattggtggctactcttgggtcgacattcccttcgtcatgttcattcctacctgcgtctgcacaagggtctacgcattcctttaccttggcccgagcaggaatgcctacatttacatcctaagccttacaagtgtctcctgcgttacccctgtataacaagacaaccgcatcttcttcagggctggcctacgaagtcttctctatgtgagtgtcatatacatttccactttttcacatgatttattgcgttttgtctactacaccgggtacattttggtttccctcagggttcgaccctaaaccctaccatccttcggccgacagcaagttgctaccgctgggcctaattacgctgtccgcctgttccacgcgcgtgtcggctacgacacgctggagcagcttccacgcgacagatccgtctctcagctggctgacaggatcgtccccttggctcgtgatcctacaagggcagggggggtctctgttctgccacgacgtgctgcaaggccgactctatatcctgtcgcactccgtgtcgctctttctaaagacgggcctccgccactgcgaggccatctatcgcgcaccgctgtggcgcgaccgacccctgccgagcctgtggacgtgccgggaccccgacaaggccttcttgccgacattactggcgagaagcgcccgacgcggcctggccgctttctacgccctgtggagactgcatctgggatcgcgctcggagctctcccaccccgtgttggagtgggagagcacagagctggtcctgacggactggagacgcgggcgaaatgaggcacagagagacgcgcccagcgtcgcggaacacttcgcgaggtgcagaccgctgctggacgaactgtgcggagagggcggatggcttcccttcgcgtttctctccacatctccgcacgtctggctgatcctaacggaaggaggccccgtcctggcggttgacgtgaacgacacctccgtgtggcgcatcgcggacgacctggagctgctgcgtcgcctggggagtctgctcctcctctcaggcctccggcttcctctccgtcccccgagcgggagcggcgaggcggccggagagccggggtacgaggaggaagagagaagagggagagcgtcgacggcgagcgcgacggccgcgacgtcgacgcgcggaccgacccgtccgacacgggtgacgcgtaaggggcgtgtggcaaccggaggcgtccatctctccgcacgccccgaatctgaggaacagacagacggccaccacgggcgccaggagagcagcgacgaccaccagcgcggcggtagcggacgaggacaccgcgatgacggcgcgcaccgccacgcgaatgacaaaacagagccccagcagcgcggagagcacgaggaaaggaaacagaccgactccgggcgccacgagcacgcacaggagagccaggtcgcaagaagagacgaggaggaaacggagcagggcgatagcgaaaggagctgcgggggggcgacgcagacgtacggcggcagaggccgacatgattcctgcccgtcgatccccctgtccgtccccgggcccgatccccgcctgtgggtccctccccctcatctgttattcccttcccctctgccaccgatgacgcccgtcgacgacgagccgtccgtccgccctcggtgtccgccaggtcccgcggaggaaccccccacgtgtcgtccccgtccgccccgcccgtcgtccgacaccccgctgtccgctgtctcgcgcccctccgctccgcccgtccccccgccgtccactgcgcgtgtccgtttcttcctctcttcctcctcctcctccccgtcctactctcccgctccgttgtctccgccctctcccgtctctccctcgtctcccagatctccgttcatcccccccatcagatctccgggactccgagcgaaaccgcgggtgtcctccgggcatcccgcggcgttcccgccggcgccctcgtccgcgccggcccgttccgaaagagtcacgtccgttccctcatcggcatctccgtccgcgtcgtgcgtcggcaagtcacagccgcccgccgcacacacggcgtgagacgccgcgcgaggtgacggaggcgacgaaagaggacgggaagaacaggcggaagaacacgaagacgaagaggaagaagatacgagaacaaaatgaggggaacacgccggggaccgagcggcggatggagcccgctcggtctcgcacttccgcgatacccagcgggctccgtcgccgcttcggacccgaggtccgacacgcccccacctcgcgcaccgcctccgccaccaccgctgacaacctccgcatatcgcccccatacacacccagcagcagagtccggcgcacgcacacgcgcggagcacgcacgacaacacgccagacatcgaccgccggaggtaacggagcccgtgcacgtcccggttttagcgggagtgtgtgcgcgcgtaccgtaacaaggaaaacccagcgggacgaaacgatcgacccactcctactatccgccctccccgagcacggtccacacgccagtccgtaaaatcacccgaggggcggatccgctccgcgcccctcgcccgatccgccccgataaaaacaagtcatctcactcgtgccagttcacacggacgcgaccgatgacaataaaaaaaaaaaacacaccaccacaaccgaacgcccgccggcccatccaccttccctcccacccccgctcgagtcgcgcaggcgcgtcgacgggcagtccctcggacgcctctacggcaacgctcctcccctgtcccctcggtccaacccctcccatccccctccccggagcacacacgccgactccgtccgcagaggcggcgaccgcagcggcagcggaaactgtaacggccacgttctccgaacagcgacagtaacggcggcggcggcggttgtcgccgtcacggtagtcgtggcggagcacccggggaggcgacgacaggtaccaccggcgccgagatcatcgccgtacgaaaagagtaccgaatgcaaaaagttaaaggttttttgtaaataaaaaaaaaatagtacgtggaaataaaaaataaaaaaaaatatacaatataatagtgtattataaaataaaaacagaataaaggctaaacaccggccaaacgctcatccttctccgtacgtcccctttccgtaagtgccaaatgccacatatccatgaacggacacacgccggcagaatccggccttcctgacagcaggtagcccgcgacctaagcacaggacggtacctgaaaccgaaagcgtaaagggcggtctcccttgttccgcccatgaggcgggacttcgagacgagccacccttcgtatacgtccggcccctcccacgcgcgcctataggacgcaccccctcgttgcgaaaccgcaacagggcacagttgccgtcacaccccctgtccctagctcgcgacgggccggcgcagaccctgccgcggcggcaaagccgagacaagaccccgacgtacgcgggcataaagaacgagaagtcgacgcgcaatcccaaattatcgcgagactgtttgctcgggcccgccctcgtcctcatgccctctccccgccctcatccccttccacacccggtagacaaaaaaaaacaaaaaatacataggtaaaagtgattttcgcggttaaacatttttccacgtgacgtccccggcgattcccggagatgcgacacgcgacacattggcccgttgacatcggggtccgcagacgcggttcccccgggggcgtcgcgacgtcggttccgcagaaaacaccgcggtccgccgtcacccttcaatcacgcggtatttccgcgctcctatgatatatctccaccgacacgggttctgtctgtcactttttaccgagccgctccaccatcgacagtgtcactgactacatcgcatacgtgctgttttgcctgtttcttgtttatctccccacccctccccgtcacagaccagcaaacaccttgccacatcgacatcgcgggcggcaaattaaaaaaaaaaataacataaatatagtgaaagagaggcccccgtcccacataaggacagaagaacaggcaaaaaaaaaaacccgtccgttattcacacagcattcggaaagccatgtcgacgcgacacacacagaggacgggcggacgcatctcggtccggcgcaacgaggcgagactggcccacgcgcgagcccgtgcccgcttcgactggctgctcctggcccgcggcaggccgtccaaactgtacggctatgcgagccggcatcgcggagaactgatccacctaccgtggccgccgtgctggtgtctagaactccaccacgatccgtacagagacgccagaagtgccaccgtgtggggccaccgctggggttggccagcgacgcacgtgagacccagatgcgttcaagactgcggtgagtaaacgtacgggcgagccgcggggagggatgtcggtcagacagtgagtgagtacaaggttcgtcgagaaccaccagagacaccagccggtagagagtggggacaaaaaaaaaacgtcacgtcaggggcggcgagtaacggaaaacgagtatgaatacgaggaggggagacgaaacatagtcaagtatgtgacgcgccggatcgtaaggcagtaaagccgatgacggcctccggccccagagacgactcgcggagtggagtccagttattgtattttttttgtgattttttttatccacaatccggtatccgtgaatccccgcagaggtactttccattaacgatggtacaggcggtataacttccggaacacggtgattacggatatcctgtctcgtttacgcgagacctctttgttgtaatctcctataacggtaaaaaaaaacacaaaagaaagattacagctcctccttttttctgcgttatggcatcctcgcattagtcaccattcctgtcgcgtgtgcttttcgctttgaattgtacgcgacaggatacgaatccgttatactccacaagggcatagcgaccacggctgtatgcggcatctcccgttccacgggatgcctttgcgtgtgcagatgttctgtgctttttttatacggtcagagaccacagacaaaaataaggcaacgcccaccataacgtttatggtttcttgttgttttgtttgggttaaacgcctcttctatcgtgtcggccggatccatcatgttcaatcgttgacgtacgcgcgtcccatcacagccctagactcctgtctgtacgtatgttgcggatacggagagaaacttcaacccgtgggtttcgtaaagtcgtatgtaaccaactcccagctcgacacgctccgcgtgctcctggtgggcaaagacggagccgtgtacgtccaccacatgagggcggcaagactctgccgactggcgtcgagcacaacggagtttacaagacgagggctgcaacgcgacgccgtgacgtatgaagaagacctagagctgccggaccagcgtatgtgcggaacgaacgcccgacatctgttcgacgtgatcgccgcggccgccgacgaacacaacctgctgaccgtcggcggcctgtgtcagacgcacgccggagtgtcctgcaacttactagagaccgtgggagatccgtggacggcggttccggccgcgcgcatgactctgaccgtgccgcaggttcagtaccggttatggcccgaagcccggagagacctccgccggcacctgtacgcgggccaccccctgggaccgtggctcgtgtgcggcgttctctctcgagagagggagacgcagaagccgtcgcctccgatacgtacgactgtgggaaacgtaccaacgccggggccacgcgaggtggagatcgcttgggtggtcttgactttggcgggacctctgttagcgttctggcccgataccggcaagatctgtcgtctggcaaactcgttttccaccttatggaagatgggaccgcgggccatgagaggacactggacgtactcggccccgggtagacatctccccggggacgcgtggccactgtgcgaacacgtgagaccgcagtggaaagcttccgaggaagagagcgtacctggattagacgccacggaggtgaagtaagcatgtcacctacggccagagacgtgaccggagaaaatcatgcattgtgtggggtgtgtatgcgtggggtgcgtatcggtgcgcgtactcgttttccttccctcttccctttaaccccacgaaaaataaaatccacgaacgtagacagtcacacacagggtgcttacgctccgtgttactgatggcaggtaaccaaaaaaacgtatgtgtcggccgtgatgcaccgccgctctatagcgtagtcgctatagcagcgcccgatgccaacgcgacagggtgagtcacatagatcgggactgcttgaaagcgcgtcgttcgcttcttatataggcaccccggggggtgggaggagtgaacatacaaaggaggtgcgtccgggattggaggcgaacgtagaaaacgaacagcgtcagaaaaatataagaaaaggcggagacacatagccttggcgggaagacgacaacaggtttaaaaatagacagtgaaaaaaatagcagactgtgacgtccaatacacatgtggcgatcatccaatcaacggggtgtatcgaggcgcagagacaaaagtatgcggaagtacacacgacacggtaacgcggaccgaagacagagggcgatcgctagcatggcaagtgtaagaaaaaaaaaaccacgttccaaaaacacctatacgggaaacatctcttcactccctccccgtcccaaccaccgcaacattcacctccgtaatccgttgtcaccgcgtttctaccacggacgcgtacacacgcagacacacagacacgcacaacccacccatgtggtagtcgcgggtgggtacgtagatggggcataccggggtgagacgtgaagacaattcaaaacgacatcgcgcgcgacgtgccaccgtctgggacccacggtggcctggcacggtgccaaaggaaaccaccggctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaacccatcccccaacgcgcgcgcgcacgccgctatgggaggcgccgtgtttttcaccaacacgcgcgccgctgcgagacgcgtga

SEQ ID NO: 129 - protein, 97 aa, herpes simplex virus 6A
MPLTVRAGHAPYRLPLSNYWWLLLGRHSLRHVHSYLRLHKGLRIPLPWPEQECLHLHPKPYKCLLRYPCITRQPHLLQGWPTKSSLCECHIHFHFFT

SEQ ID NO: 130 - protein, 100 aa, herpes simplex virus 6A
MRGTRRGPSGGWSPLGLALPRYPAGSVAASDPRSDTPPPRAPPPPPPLTTSAYRPHTHPAAESGARTRAEHARQHARHRPPEVTEPVHVPVLAGVCARVP

SEQ ID NO: 131 - protein, 103 aa, herpes simplex virus 6A
MSTRHTQRTGGRISVRRNEARLAHARARARFDWLLLARGRPSKLYGYASRHRGELIHLPWPPCWCLELHHDPYRDARSATVWGHRWGWPATHVRPRCVQDCGE

SEQ ID NO: 132 - protein, 363 aa, herpes simplex virus 6A
MRHLPFHGMPLRVQMFCAFFIRSETTDKNKATPTITFMVSCCFVWVKRLFYRVGRIHHVQSLTYARPITALDSCLYVCCGYGEKLQPVGFVKSYVTNSQLDTLRVLLVGKDGAVYVHHMRAARLCRLASSTTEFTRRGLQRDAVTYEEDLELPDQRMCGTNARHLFDVIAAAADEHNLLTVGGLCQTHAGVSCNLLETVGDPWTAVPAARMTLTVPQVQYRLWPEARRDLRRHLYAGHPLGPWLVCGVLSRERETQKPSPPIRTTVGNVPTPGPREVEIAWVVLTLAGPLLAFWPDTGKICRLANSFSTLWKMGPRAMRGHWTYSAPGRHLPGDAWPLCEHVRPQWKASEEESVPGLDATEVK

SEQ ID NO: 133 - protein, 110 aa, herpes simplex virus 6A
MWRSSNQRGVSRRRDKSMRKYTRHGNADRRQRAIASMASVRKKKPRSKNTYTGNISSLPPRPNHRNIHLRNPLSPRFYHGRVHTQTHRHAQPTHVVVAGGYVDGAYRGET

SEQ ID NO: 134 - protein, 123 aa, herpes simplex virus 6A
MAPAREGERERDGRQSRRGQTRIRRRRENGRGRSRGGPARAREGVERTRVETPRRAVDLSADIFADPRPVSLMQTRARTYTDTPTRPHRADCHVSENTHAREKKKQQQKNTHTQKNYTHGEKK

SEQ ID NO: 135 - protein, 82 aa, herpes simplex virus 6A
MFHTKQSEEGCSPLMPNLAAAVPCRPFVNLARETGTTNLLVAGSRPTNTGVRNFVINLTVGESSSSRRTANRILLRSFTSLL

SEQ ID NO: 136 - protein, 436 aa, herpes simplex virus 6A
MEIVTYKTVSARSPTVTWSSGFGRAIASIQKRNQDNIRKPLRFYTGLLHCLIKQYEHCLVPPNKSIRFDKGKIEVAALILDLGHQVLGRQIHVRQRIYSWTSITLPKLFTPKELYFLIASPEEENIAFNPTITKGGWISGSFSYPVDYRSNFSLTGMSANILMVPFVPYKYPLNYARFISSIDLMILNEQFPEHECGDIQILKQRNYLYLGVIKNLTWKKSVTGTGQTAPHRILKASFIGSWPDTSLPDRVALRFFNNTRFTIHCHEFSINIENLGLVKNKEKVFGTLATVCCEQIPSLLTTENLPKYLIVQFEVVTQIEEPEPLLFSSNPKLYFTGDVLNATIQLQHNPNYYELLVHAPYDIHFYPSRCHIVILPIRYFTKPDKQILISGYQNEGFFETQVMLWAPGTPLHITLRSFSPNLILPQSTKRRNRKAV

SEQ ID NO: 137 - protein, 318 aa, herpes simplex virus 6A
MESAVTGITLTTSIPMIIIVVTTMILYHRVAKHNATSFYVITLFASDFVLMWCVFFMTVNRKQLFSFNRFFCQLVYFIYHAVCSYSISMLAIIATIRYKTLHRRKKTESKTSSTGRNIGILLLASSMCAIPTALFVKTNGMKKTGKCVVYISSKKAYELFLAVKIVFSFIWGVLPTMVFSFFYVIFCKALHDVTEKKYKKTLFFIRILLLSFLLIQIPYIAILICEIAFLYMPQNTCFWLARVEILQLIIRLMPQVHCFSNPLVYAFTGGELRNRFTACFQSFFPKTLCSTQKRKDSDASEHDQNSKSKASVEKNQPL

SEQ ID NO: 138 - protein, 106 aa, herpes simplex virus 6A
MAHAKKRVRRKLLTSTDDPILSNTFTMRPTSKIADAEIISREHDYIASKTQTDSKKISPLSVILDKTVLFEFYGIGDNNEKAIVYPIDPDFLLCDSEHNCTLSPFL

SEQ ID NO: 139 - protein, 609 aa, herpes simplex virus 6A
MVTHAMEEPKTFNIPTFVLDENCNFIPEVLSRANAKYIKDVLIQDSYNTVCLANSFIPMTIQTAEQIMVIITKFKFSRARDLFEKVLRLGVHINRFYAGKKQVKHMITMMKSLFDTEEAMRRLDRALMGLFVDARGSSYMPLIALSLHENGLPDSKFTKAVKLINTTLNSFHNRPDADIEQYAQKLRAYNYLYKIPHYTLKEAVDVYSENLKDLSIGVNKKPTLLFTSSDDGYLSHIFNDMLFLTSTWNMIYNCKVQIRRLTTWIKYEINSIVEDCVLVGFQLPDLKDTILDLAALTSNMNLVDPDKDLFSHYKLILEKLFEISIFATKANICILPTFIKSHLIEFEDVLKRSNDDEDLNYLLLKSNDSDDEYDEDKLPIQVDPGRVDNVLTDSNFFNVTADNAFSSIAIMPISYDKIIDVEENVIQVLEVEMQSLSAVVYGAVANKYGLSLPQVIKRLNQNEGRASSRASSSHSTSTIPYSPPQSGRSTPTSILRQRAPIRSNSRSSSVSFSQDDDNRSHYSDETNISDYSYPMADLDLEDEEPMEDHPHSPQSASSNNSMSRRSRALQNEQRRRTPTMAPPSPARGQNNARLRRRTRRSTETNDERL

SEQ ID NO: 140 - protein, 1082 aa, herpes simplex virus 6A
MTHDNRQLLPQETKLVTPNKDTLSSRYLHVLIIDNTLSTIEFVYMAVKAVLTQVDTLNALEQRKNRPTNRILGLSTSVSKRYINIPKFSSSGASNSQGVKTLAAIRKFCLPDKNCFRNFLSFSTTLFKVPSSIDIYFLFFTASTVSTMAARALDLEFILSSLKNSTSPESLLAATAKIELLSLAADSVTHNRVIAFINRLTPKKYHFDLIRQYAVFYFLNSTTLTSENKLLSAELLYEELSQIPSSSSSGTELENLNNAEVLYVFDRILNSIKMLKNELSSPIGKLRAQPAANDPGTDKTIKYSKIQSIIQKINSFTHENSLLANCRAVVELIDDLYRKLYSWFLHVLTFEDIQFPGDTFLDRLLKMDYCFTYYPSSNRHLIDLFEKTLDNQTFTNLDKFFDTSGNSPELLYQKTFSLKIFSKNLTAQDNGLYIYPLLKTDLSILDFLGTENILFHRGLIYHILHQKTIPQERENDLNKINQFFATVIQQVIETKSSCLPASLSQLLDTIFHFNRIGLNMETCRTYIEILSNHMATPDTQPIINTFTINLTHIVFTAHVFFICMENFSPTFIFYNRKKLILEQQRAILIIERNDYSTLWKQISDHIECLFNVSLSESFFKEYTKGGNEDQKQFLYKNLFEKWGNVFFPFTYSVSTSNNSTAHHITTLELRDICKEVYQSDSPDAYESLLPYSTHPSFKTLFVKIYVIPMVSHITNLTFDKLQSDCRLLTLIHACKLLLPSQHLLLHYMAWLYAFSINVDHIDLGTFTVIKSVIFKIADHINVMTHTIYSPETNLLVSILLNAYTNYLQKYVNPWIKQTITANFSLIQTYITFTKQCASILATKCNINLDNLFIYITIGTDKIVTTSFCSFIATCRNLVRQHEEFEKSLQTIQISEITLTGMLRNIITSVSSSKELLTNEALQKFIDTVQRISQHVNETYHSISVNLEKCKTSNDILIESLKKIIYIVDVLSSNAILNTSLASRCLEAANLAVSNNSFTILEIKKDAVAVFKPFITQLFESMKPTTSLHKKLMSTQKLTTDHIPFLDTFDDRYNLVRHVERQLNWYAAHAEAAQQDLITPLKF

SEQ ID NO: 141 - protein, 2077 aa, herpes simplex virus 6A
MKIITSSTNQNDSKYGPRAGKQCMSNSFSFLHTVYLNGINNSLNAGTIDAIMEEGYHLDTAGTLALMLNNSDSQDYRLPTEIPKRIHSRYGVTQHELSRPFNGTLDTQKIDNEVYLGLIDFILYGKSKNGPTFAVITIGVLSRALFFLNNTLYLFDSHPTEREATAAIYICQNIEEVYELLTTHGTEGFYYDASLIFFIETSNLSLSSHDAELLILKTYKDPDIAIALDKFSSTEIHEIKKTDDIGSQQDLVADKTTDLEHAPHKRKKNSHSLELELNDKKKKDTASLTYYATEVDLIPSFYELRSQFQSLFHDLKSFPIMKSNFNWTIYLQDSPINPNQPFATPFLWNRVFHLLCQIIDVFVGVGSTNDDSSKQQQQTIFINYLLPFKDFSEVFNEALAACQENNLDIIFIYNNYLCKTTTFRTLERILLSKFLAIVDNDHKKHYEWVKSWTTQMFQGMPKKLDDIENYLKAYVDHNPVKHFHEFICLNKAEKYKVAVLLNEKRKEIQEAIEREKNSFAQLSNFIDKLGETPALPIESENVHKVHTSDITEGIVPRFITESIELPNISTLNNTQQISLDKQLNEKLTNTIHTLTNKFTKIVQDNYNNIAAGFMPVTELNCLFAYLVNLYFNIEVLKHSGLNINTVLLQEVEKLYDNTQFLRFGTSHFNINNLSNFTLSIRKMFVDFYNSQKPSDRASEILAAIESILADPSKNKTVVNIEMIKSQLEELGKMEISTTENKQTAAITKQILGDQELTPIYDFLHHLSAYNLPNTTTVKNLHLHFILEQRPDIAMTLHDKIQSILDIYVDDMLNDITVPEQTFSTVLFLVDLFPNSTEKTALFESVLTLRQLAKKCANLKTLDEFDDLAQFITTNSEQLQNMMRQHFGKKIPTLMGHIKFLYSQKIITTEEKNWIQRAKTVVITSPEELTAFLATAPTKHALQTCKPDLDKALQRHMEEQMKQTAENDKKHILTIRSTLEKRLTDILLILKDGQFSSLETMHLNLLETFLKQLQDNNVIIHFTHALLPVLKDIETTISKIISDVIEKILIKTPLNPEQMSKEEQKYTPLLSFLSKFKKTTFCTEDVKTEIEQVQKSITFLKKIATSTNKHTRLSHSIYGQELNLYEERITELRKETNKMKEQLSKEYALAEKKILLSSQDAKTDKIYLVLNTHTLKEIKNTQFKETAFAKALTVEVNNKENQLQELLNHFNAHLKAKMDQNHITKLSFDTKWTAFVSDSRLYIPDFINIKLQDFISDPFKVISQLMNKATNEMPYIQAEITLKWLTKLIHDINKFCLSAISEFGKEAIPFNYAALRDLEYQINTKYVEIENKVICNETVENTKNIPKLTKLLKQLDPKRVAGGQEQYQTLMNKILTSETSMQQTYEKEQLKKEYFEIVNNVASFKLAFNFPQQLQNVERLIEKFKSLPKSQPFEKFPQENDLLSDSLNTENYINGLRALLNFITAAQNYIQNTLLKQWAVFQQQNFIPIDYSVANVKPISDLYARLRIERERQVFYQVNSVFGTHLIVDDTGVPLQFHNIFNNAIVKFFSLNYKQINVPEDTPRLVSSQYKLLSVCKSFIMILQQFWENIITLDLGPYLRDGTQNFKRELIPIVNLKLFIYCITQAWTASEDSTVSTAFELPIKQFTLLILCSHPEYLYGCLSHSTDLVINSLAKSIDKNSLYNTFVVSHNPPEKPMHLMRNICIDTQLWQPAKLMKDTFQQTFFTQLCPKNEKFFIYLTAFLILPYKFMNYIWIQYKPAIFTQRSYQNLIKDLCSEYVHQNKITTSSVTPHEPDTIKSGERITSKITVHKAQNTPTLTRLQAQEYVFDYILYSFLTGYEMTFAMYIDIIEKTYLLCMRHLENVLHDKDFQSVLRARTFDIDYILKQSWTKNIVEHSLFSVQLDKIVSYLNHTNRATPNIPLILFNYDNEVVNVYLPPMSTNPKKVAFYIKNPFHFPVQEYEATNLISFHLYPKTTDILNQLPPNNTESTRPGKQTSETLTNKNLSEPKFKKPAVTGLMPKSQSIILSTDTNVPETSPDVKANTASAAIKDVTLAREKINEFSESINTTISKLKSMYL

SEQ ID NO: 142 - protein, 484 aa, herpes simplex virus 6A
MYKGWDSEALPIQSEILNEILLYCYLTPQPPIPSETTTATSPTNIENEISNLDNSENLEELKQLSVALNIDRRCNICSIVNLCLKQNKSWIYDYSLLCYKCNYAPKTPLSLLIVSTEFLMLIRERFPNINFDGLFLNNIVSIFDFHVHFFIHRCFANTVNDHIQSENITLNHMAIIRSTLLKEDTIPHIKIKKFLTKKMNPKKTQSSELNKKLTVPMKTRFTTLLFYMWSGTNVFDRVPFTDLTIRKHRFIKNLYSNKTDIELTAGPILLAQIPFSITKNKTTSVCLLCELMAASKQDYLFLKYLHQSIMDYCQNNLKMIDRVQFVIADIFEKTKIHTHVKNLSDYSKAIFDNEFSFSDDNFTLDTHVYLILRQTGTVGVYKHFFCDPLCLANCKTINPEVLFNTTDAGEIQDLKVTICYRNEYLSIVEKHVWLAIHLFKAFQIIKPNHKNKTQITEFLKDFTNLLALHHFDIVDPIFTVNYYV

SEQ ID NO: 143 - protein, 264 aa, herpes simplex virus 6A
MTVHKSRIRRSRSLSVTHRIQKRPDHREKTKLYLQLKLHDLHTVFNLFPEYEQKFLAIIKLPITGKEPIDVPFSLSNHHQHTCLEFSPYANEQISKSACLHCESVSVPTSSDAMVAHLNQVNNVMQNRLYFYGFRKDMELIRMSAKQPTIFQIFYIVHNTINNIFPIMFERKQKLGMHIVFQSRTLHIPCECIKQIVAVSSGYNVYLDILQESVILTVLCETLDTNTNIHIDIGMLQKKLEEMDIPNEISDRLEKYKGHLIGFH

SEQ ID NO: 144 - protein, 213 aa, herpes simplex virus 6A
MSLGYWGVMGNCFRRLSLFGQPTQAKYEMLCSSDDLETEELTFFLDMTYKDFGVYQNDIISHQKDTETMKTLLGLLPMYKKTKLRHTVMERCLSNCPNHVKDALCVELMKAEKILQTMDVVFMKTLIGEFSMCTENLNQLLNKFATDQSTLSDVEKINSLIEIDGENSKRLLVELDPILHEETGLYQALPNVVTEAPSEKVKSIRVESEGESV

SEQ ID NO: 145 - protein, 84 aa, herpes simplex virus 6A
MSCKKSARQSLYVSLCLFYILVFAAATEVDFYSPECHSHTYEIVLNSFSSIWLLINLFLLLCSFAIFLKYWCYKTFASETVKGY

SEQ ID NO: 146 - protein, 252 aa, herpes simplex virus 6A
MSLTGLPDIRKKIGQFHHLRIYKQILSLQGNFARLNYFLGDVFPANLRSASVSVFFEVRLGPRIPDCIVLLKSVDAKDEFAFHCYFFEFKTTLGKSTMQSVHHNCIHQAQYLQGLRQLQQSISFLDQYLIADEVSWNVVPVICFFRQWGLKLDFFKKFSGKTKRLSFSFIRDLFARSQDGAVQSLLSIPNYTNFRRACQKHTDLYRKRCRKAPKSVLTKTSGENRSRASRQVAKNAPKNRIRRTAKKDAKRQ

SEQ ID NO: 147 - protein, 301 aa, herpes simplex virus 6A
MEKETKSLAWPATAEFYGWVFIFSSIQLCTMVLLTVRFNSFKVGREYAVFTFAGMSFNCFLLPIKMGLLSGHWSLPRDFCAILLYIDDFSIYFSSWSLVFMAIERINHFCYSTPLLNENSKALAKVCFPIVWIISGVQALQMLNNYKATALQNETPQCFLAFLRSGYDMWLMLVYSVMIPVMLVFIYIYSKNFMLLKDELSTVTTYLCIYLLLGTIAHLPKAGLSEIESDKIFYGLRDIFMALPVLKVYYIPVMAYCMACDDHTVPVRLCSIWLVNLCKKCFSCTRREKESDLEVGIKMLK

SEQ ID NO: 148 - protein, 528 aa, herpes simplex virus 6A
MSKVWVGGFLCVYGEEPSEECLALPRDTVQKELGSGNIPLPLNINHNEKATIGMVRGLFDLEHGLFCVAQIQSQTFMDIIRNIAGKSKLITAGSVIEPLPPDPEIECLSSSFPGLSLSSKVLQDENLDGKPFFHHVSVCGVGRRPGTIAIFGREISWILDRFSCISESEKRQVLEGVNVYSQGFDENLFSADLYDLLADSLDTSYIRKRFPKLQLDKQLCGLSKCTYIKASEPPVEIIVAATKVAGDQVQLTTEPGSELAVETCDVPVVHGNYDAVESATATTAMSNQNLPNTTPLLSSPPFSDCVFLPKDAFFSLLNVTTGQQPKIVPPVSVHPPVTEQYQMLPYSESAAKIAEHESNRYHSPCQAMYPYWQYSPVPQYPAALHGYRQSKTLKKRHFQSDSEDELSFPGDPEYTKKRRRHRVDNDDDKEMAREKNDLRELVDMIGMLRQEISALKHVRAQSPQRHIVPMETLPTIEEKGAASPKPSILNASLAPETVNRSLAGQNESTDLLKLNKKLFVDALNKMDS

SEQ ID NO: 149 - protein, 772 aa, herpes simplex virus 6A
MQHTGNCETLIVNSCFGSTCARSIPVFIDSCDLTAEVSRDEETRLARSMPVVLEKIESIIEKIFQTSGPNIVHDKDRAKIALCRLLLGPVAVPCFCEEWDTNDYLSKSGCKCIGPILYIHTSRCRCSDIPVFKFSIMKDYYASHVFRGLLSLKEWNTHLPNVLCTCELSMSDRYVATVYPKQNSIYLEYYPYFLCYLCRHLTVIEIEQCTNDLISLLGPKVAQRVIIHFKLLFGFRHKPHIGTVDSWFWENFFMLELHKLWLTVVKHNRVTTDFFNVVYEKIQNYKQYAIKTLRMSSKAVPAIQRLCLAKFKQQLLYLNIKVTVKKNKREMCLNGFVYGKTLYVVESSQLIFRNLLLLYYDYSLPDECKTNEENVLTAHYIRVISRLSFKRSRSALPPGVRPDFIFVAQQPKRKELPNVPGGIDFAEITSVRHGAVTLNAFNTNKVMNLKATISKRANFVYHRIPKTMTHSFVMYKHTFKEPAFTVSTFVSNDDLDMSSLNINIRGPYCDFLYALGVYKMHVSIRDLFLPAFVCNSNNSVDLQGLENQDVVRNRKKKVYWITNFPCMISNANKVNVGWFKAGTGIIPRVSGEDLQNVLLQELNNVREIPGLVFDMDLHQLLVLLEQRNLHQIPFLVKQFLIFLRLGLLMGYGHSRRNKVHDIMLHLISNGLFDFNKNSVANTKIKHGCALVGTRLANNVPKIIARQKKMKLDHMGRNANSLAVLRFIVKSGEQKNKTVFIKLLEYLAETSTAINTRNEVARLLQTLTAKVKT

SEQ ID NO: 150 - protein, 85 aa, herpes simplex virus 6A
MNSALNGIKDDFENCETKDDLFKIIDKISKNCNFIVEQVESLPRRVDSAAILFDNLAVEIFNDVIYRQNGVAAKIRQGNGQDIDT

SEQ ID NO: 151 - protein, 442 aa, herpes simplex virus 6A
METHLYYDTLYQYQGGVYPAHICLPTDVCLPMRVDCIESLYFRCVFFKSGMHYTEWSKLKFTVISREIKFKDVLKDADSDEVFTGLVVMTIPIPIVDFHFDIDSVILKLVYPRLVHREIVLRLYDLICVRPPSNRPSEASAKNIANDFYQLTSRENKQTPDEEKRCLFFQQGPLEPPSTVRGLKAPGNEKPIQFPAHANEKMTESFLSDSWFGQKVRCKKILDFTQTYQVVVCWYELSFSREMQIENNLLSASQLKRVNAADFWDRTNRYLRDIGSRVLTHIVKTLQIHNRQFKQKFNCNFPDNFSFDRLLSFMQLGKDFWILNLTLDSCIIKAIICFLGFQNGGKSFLAQDEVWGDLIDCSKGSVIYGEKIQWILDSTNNLYSTCREKQNKSWELYVDCCALYVSEKLELDFVLPGGFAITGKFALTDGDIDFFNWRFGLS

SEQ ID NO: 152 - protein, 353 aa, herpes simplex virus 6A
MWVMSQVRSMEPDLTLAAVYQAAANLTEQDKEIFAEAVKTAFSVCSSAAPSARLRMIETPTQNFMFVTSVIPSGVTSGEKKTKLNIDAALDNLALSFANKKSKKMARTYLLQNVLRTQDQQVAISGKYILYTKKHIETSLMIDKTKLVKKILEYAETPNLLGYTDVRDLECLLWLVFCGPKSFCQSDSCFGYSKTGYNAAFPNLLPPYLYECGQNNGLFFGIVQAYVFSWYSDFDFSALEISERARRRIRSLLYDLKQKFAEQEVSVLSVASQMCIFCALYKQNKLSLEYVSGDLKTSVFSPIIIKDCLCAQTTISTTQMLPGTKSSAIFPVYDLRKLLGALVISEGSVKFDI

SEQ ID NO: 153 - protein, 562 aa, herpes simplex virus 6A
MDNGVETPQGQKTQPINLPPVRKKLRKHEGLGKGVKRKLFAEDSSPLKKQISACSDMETLSSPVKSECESRSASLDESFGKCKHEIACDCSAIEELLCHESLLDSPMKLSNAHTIFSSNKWKLELEKIIASKQIFLDMSENAELAAYGETLCNLRIFEKISSPFLFDVQSEERSYSVVYVPHNKELCGQFCQPEKTMARVLGVGAYGKVFDLDKVAIKTANEDESVISAFIAGVIRAKSGADLLSHECVINNLLISNSVCMSHKVSLSRTYDIDLHKFEDWDVRNVMNYYSVFCKLADAVRFLNLKCRINHFDISPMNIFLNHKKEIIFDAVLADYSLSEMHPNYNGTCAIAKEYDKNLQLVPISRNKFCDMFNPGFRPLVANAMILVNVCGAFDGENNPLRHCNLDLCAFAQVVLSCVLRMTDKRGCREAQLYYEKRLFALANEACRLNPLKYPFAYRDACCKVLAEHVVLLGLLFYRDVVEIYEKLYDFLDERGEFGSRDLFEATFLNNSKLTRRQPIREGLASLQSSEYGEKLLHDLRELFLINSTADLDKDTSSLFHM

SEQ ID NO: 154 - protein, 488 aa, herpes simplex virus 6A
MDLDQISETLSSVAEEEPLTMFLLDKLYAIREKIKQVPFSIVRLCHVYCMLIKYNASNNNCILGRKLIEEMQQFLCGTRVDGSEDISMDLSELCKLYDYCPLLCSALCRAPCVSVNKLFKIVERETRGQSENPLWHALRKYTVTATKLYDIYTTRCFLEYKGQQFFGEAVIYGAKHERVIRHLVATFYVKREVKETLGLLLDPSSGVFGASLDACFGISFNEDGFLMVKEKALIFEIKFKYKYLRDKEDHFVSELLKNPTEKSFSDFILSHPVPVIEFRERGKIPSSREYLMTYDFQYRPQRKLRTCPTPAILAPHIKQLLCLNETQKSTVIVFDCKSDLCEQKLSVFQKAVFTVNVFVNPKHRYFFQSLLQQYVMTQFYINDHNNPEYIESTEVPSVHIVTAFFRRRTEEERSLHLVIDETEYIEEEIPLALIVTPVAPNPEFTCCVITDICNLWENNICKQTSLQVWAQSAVNQYLAACVRKPKTP

SEQ ID NO: 155 - protein, 780 aa, herpes simplex virus 6A
MENRFQNDTLFSEWFGQSLSDVRFPDNVTVYSQADSAVSFENVRQPIKLVRAAMGSGKTTALIHFLKQVPRELSVLLISCRKTFAAEILHRFTLNGLKDFELYCDITERQINNRKVIVQIESLHRLTENYDVLILDEIMSIIKQFYSKTMTKTKEVDCKFLSLIKNSSHVIAMDATLTRHVVEFFAAFKPDTQIALIRNTFVSAMFSNRIAYFCDTFFGKEFSFFARLEDKLRWDKKLCLFCSTVLAAEYMYDLIRSRFPLKKVLLLTSKQGKCSSIESWIRYDVVIYTSVVTVGLSFEPVYFSSLFVYIQLAKGGPDMVSVFQSIGRVRRVIDEDIYIYMNPVLIRSYDPLAPIAIPPCSDWSVAEQSIISESCIDFRGKCSGAHKYNFCSVLKSLFRYRHYIEKTTITSLSDSLFLLCSLLCENSIKVDIVGNGFPMRKEVFLSFLQILVEECHFIEKKITLPGDDMTFQEIISSRETIMNGDFYENGDQLLHKDYITDMGKFRATFLSPGVDIFIASDIVYDLKNESKRYVFVNVWLQKCVSAGVESTEIERVFCERIKCYMLPKSFLCDEYFVLGDISGVYEWGMLIDLAFLAEMIRKDLKLKSCTDTTTDISEDDLLLCAARRSSDILQIMQLVFTVHVQFFQKYSLQTLQLFNKLRGMRIVTGVFSIEKFSISILRLFFKCAFNMTLSASRPRYIPGKAYRNLTKNDMENMLDNWEISRTNLKTCKELRKALTEASRARRKQTIYKLQGSDISLSVSEVGVFGQHASPGVCVSS

SEQ ID NO: 156 - protein, 824 aa, herpes simplex virus 6A
MSISSLFGGRYDNKFLLNMSSAPKIELIVDKVASLSERRLEGRLPEDWFRHIMDPETEFNSEFADALCIGIDEFAQPLPFLPFKALLVTGTAGAGKTNSIQTLAANLDCIVTATTSIAAQNLSVVLNRSKSAQVKTIFKTFGFNSSHVSMSERQSYIANDERSIQIQQKQDLSIYWNVISDIADRALGAVACKTKELPDLCESSVIVIDEAGVILRHILHTVVFFYWFYNALYKTPLYEDGIVPCIVCVGSPTQSNALVTSFNPLTQNKDVKRGIDVLSALICDDVLSKYCEVDNNWIIFVNNKRCADHAFGDFLKHIEFGLPLKPELIEYVDQFVKPASYIRNPMNEIETTRLFLSHNEVKNYFRSLHEQVEVTNRNNLFVFPVYFLIKNKTFEDYKSEIGNFSLEIEPWFKSNIHRLNTYSQFADQDLSKTVQLEEIVLEDGSVEETLITCHLKHIRNSSIGVTSKIKASTVGFSGTYEKFVELLQSDLFIEKTSCDQTIHAYSFLSGLMFGGMYSFCCSKFTTPEVLMEIKNIKMPSIEFLESEMSRMSPDVQTVETDERYDFGLVNDGLSDVDLLEIDPCGDPFFTRYSKLPLTNSLSFEEISLLYTTFKDIFISRFAILQKHTKGKFGKTLLVTYNRNNVSRKQCGEIYSHLKSFYGMLTYAIPANNYTLEGYTNDNVVHLGTDKQLPQILYKKGLPRLVIKDEMGFISVLDNNVSKFIDVVNGQSFHLCTTVDYATVSKVSMTITKSQGLSIQKVAIDFGSDPKNLKLSSIYVGMSRVTDPNNLIMNVNPLRLNYENDNFIAPHIVKALKNENTMLIF

SEQ ID NO: 157 - protein, 344 aa, herpes simplex virus 6A
MYAEERAYGSFDDVMEVYQQIVTESIQLKRLHFGSGCLIEFLGDSGTCETFCGGWISMICWTSDTNSMGSLTVDIGIDDGKYKTYNARGFLLCSKSITSISQNTEGRDRILTVSQENNKLQITFVTLTKVFKEHDIRNLGDPKCIEKFEKECRALDRKKHDDEHRKRSGKQKEKRKVEDTDKKKDDDRRKQEERKRNDEDKQPDKKEESDGKYKCIVVVNFYFSCVTVVDFFLNSICFVAISELPKEKRQKYHDMKRNLEEQSHEDGITLTSTTLVNGAVEGALPPCISIDNHEDQQHDELDKRAYAQVGGVSGSPKPRSSGSLLCVSKADLFILGDEPRRSIQ

SEQ ID NO: 158 - protein, 97 aa, herpes simplex virus 6A
MAIGFICSSPDAELFSEKSRMSSSVLLGCLLCCMDWSAAVPGKTEPFRKLFDAIMIKKLKSCSAAYPSDLDEGSMCDMADASPTSLELGLSKLDKES

SEQ ID NO: 159 - protein, 413 aa, herpes simplex virus 6A
MYVSVSVHVSVHVSVRVSVRVSVCVSVRVSVHVSVRVSVSVRVSVRVSVSVRVSVRVSVSVHVSVRVSVRVSVSVRVSVCARVCARVCVCARVCVCARVCVCARVCVCARVCARVCVCACVCVCACLCVCACLCVCACLCVCACLCVCACLCVCACLCVCACLCVCACLCVCVCVCLCVCVCLCVCVCLCVCVCLCVCVCLCVCVCLCVCVCLCVCVCLCVCVCLCVCVCLCVCVCVCVCVCVCVCVCVCVCVCVCLCVCVCLCVCLCVCLCVCVCVCVCLCVCLCVCLCVCVCVCVCLLCMSLCMCMCMCMCMCMCMCMCMSLCMSLCMCMCMCMCMCMCICMCMCICICMCMCMCMCMCMCMCMCMCMCMCMCMCMCMCMCMCMCMCMCMCMCMCMCMCMCMCMCIIEGNK

SEQ ID NO: 160 - protein, 71 aa, herpes simplex virus 6A
MGKKSSTGTGKTNLKILACLLLIFLMATIFLLILEIISGQRYSNDDSEGVTAALKHVSTPTTNCTETTTPG

SEQ ID NO: 161 - protein, 114 aa, herpes simplex virus 6A
RICLFYFNVLIIYLHTFLKNEKKNITDGLFLDSVTSQAMENKESMKKNEGEPPVWIQALTTTLSIILLVCIIMACIICSRTTEEEKSEMQSSASSVETLQSLNEAIFPKGEMNV

SEQ ID NO: 162 - protein, 1121 aa, herpes simplex virus 6A
MSAHPDDLFWQQILNMDPTELLSDDVISSTCDENTAAGTDIMQPLCVDMSVQPTTSGCHTGAMMSDSYFSNDTPDQNCQSHSTLTDLSPEDMNNQINVQPNQMTFQPISPPIQDQNYGYSNNMINPIKPASIIKLHGHSIGEMTVTDPSSHVNAQHFVQQSNPKFFLNMYPCMTANSQGPGECQSVHNQSSGSGSNSYDINTAPRDEWIFTTSGGESWVLKRNTPNPPNSRTNLIFNNAQPIFHTQPQVSGFSDCSYQGGGLNSREYVNLAGYTPVCNMQNIKNSWATQLGASIDCMTASPTGIDANVNSAFQPVGVVSNNRGANVSMGGMGNYIENNSPWNQYYKSEMANNSINVKESNVYGHVGCVNDAISDKQGGTANVPSSLLNPDHQDWMRMTGTNTHMLNNINTNTEMENYDFPENDGNVHGATGVDLSTLSNGQQHSAFEGNGTFPVVNTGNPRTTLNCAPQLFLLGGNPTIAHPMNGNNETPDKNVCKPTPSTGVIKKLNFDGVDRGGGIGNFPKLASFVAMREKMSNTVNPSCGTFLEQLEGLRQQNSFEKNISFADLHFSEEDDVLSSASSVSCNSNCDMKIEVSQQGITVSNLQQGFRQQMNMNSSVVKMDGSYKTQEMSNGCATDVTDNAGTIQQNKRIHSQNENPEDGQVREGGCSDVRNEPPRKSARIHNMKSEGVTCGMCMTAADSTRQDASGGSSSGTKNEYYDDESELTGLSDTDSDNEVQCCQEVTKVGPKTYSSENFNPEYRQAKRLLADIPYRRWIPDPVNMEDNDGPFIPIVTRPATVCMNGRRRRTFFRQCVTAFGPLSKLTYFKELLQSYVSKNNNSYLSISWPPKHGVYVMSEKKLGYEHIPTLKDKFPLPCGWMMVLGVVGAEPPAALNKNMVILLCENRWVLLHNYSNSTHELFLAASDLKQFMEEGLSRCDPIYEESTVPYGVAMENSLRDFLRNSRTFQDLMDQRDNMHGCNWTFNGMPGRLGDRVIHLCNPESVDSIPGDEAVVCEGRPLYFFAYVTTFKSNPATKATVLIAADKDLRIYGYHKGRPRIRYLCKNVKTFFKAGARKFYLDFQITPKRLLAVNEEEYLNTLQNAPCLLLKPSVFRNIYSQEGK

SEQ ID NO: 163 - protein, 97 aa, herpes simplex virus 6A; identical to SEQ ID NO: 129

SEQ ID NO: 164 - protein, 100 aa, herpes simplex virus 6A; identical to SEQ ID NO: 130

SEQ ID NO: 165 - protein, 103 aa, herpes simplex virus 6A; identical to SEQ ID NO: 131

SEQ ID NO: 166 - protein, 363 aa, herpes simplex virus 6A; identical to SEQ ID NO: 132

SEQ ID NO: 167 - protein, 110 aa, herpes simplex virus 6A; identical to SEQ ID NO: 133

SEQ ID NO: 168 - DNA, 1863 bp, herpes simplex virus 6A
  CDS (1)..(1863)
atgatttattgcgttttgtctactacaccgggtacattttggtttccctcagggttcgaccctaaaccctaccatccttcggccgacagcaagttgctaccgctgggcctaattacgctgtccgcctgttccacgcgcgtgtcggctacgacacgctggagcagcttccacgcgacagatccgtctctcagctggctgacaggatcgtccccttggctcgtgatcctacaagggcagggggggtctctgttctgccacgacgtgctgcaaggccgactctatatcctgtcgcactccgtgtcgctctttctaaagacgggcctccgccactgcgaggccatctatcgcgcaccgctgtggcgcgaccgacccctgccgagcctgtggacgtgccgggaccccgacaaggccttcttgccgacattactggcgagaagcgcccgacgcggcctggccgctttctacgccctgtggagactgcatctgggatcgcgctcggagctctcccaccccgtgttggagtgggagagcacagagctggtcctgacggactggagacgcgggcgaaatgaggcacagagagacgcgcccagcgtcgcggaacacttcgcgaggtgcagaccgctgctggacgaactgtgcggagagggcggatggcttcccttcgcgtttctctccacatctccgcacgtctggctgatcctaacggaaggaggccccgtcctggcggttgacgtgaacgacacctccgtgtggcgcatcgcggacgacctggagctgctgcgtcgcctggggagtctgctcctcctctcaggcctccggcttcctctccgtcccccgagcgggagcggcgaggcggccggagagccggggtacgaggaggaagagagaagagggagagcgtcgacggcgagcgcgacggccgcgacgtcgacgcgcggaccgacccgtccgacacgggtgacgcgtaaggggcgtgtggcaaccggaggcgtccatctctccgcacgccccgaatctgaggaacagacagacggccaccacgggcgccaggagagcagcgacgaccaccagcgcggcggtagcggacgaggacaccgcgatgacggcgcgcaccgccacgcgaatgacaaaacagagccccagcagcgcggagagcacgaggaaaggaaacagaccgactccgggcgccacgagcacgcacaggagagccaggtcgcaagaagagacgaggaggaaacggagcagggcgatagcgaaaggagctgcgggggggcgacgcagacgtacggcggcagaggccgacatgattcctgcccgtcgatccccctgtccgtccccgggcccgatccccgcctgtgggtccctccccctcatctgttattcccttcccctctgccaccgatgacgcccgtcgacgacgagccgtccgtccgccctcggtgtccgccaggtcccgcggaggaaccccccacgtgtcgtccccgtccgccccgcccgtcgtccgacaccccgctgtccgctgtctcgcgcccctccgctccgcccgtccccccgccgtccactgcgcgtgtccgtttcttcctctcttcctcctcctcctccccgtcctactctcccgctccgttgtctccgccctctcccgtctctccctcgtctcccagatctccgttcatcccccccatcagatctccgggactccgagcgaaaccgcgggtgtcctccgggcatcccgcggcgttcccgccggcgccctcgtccgcgccggcccgttccgaaagagtcacgtccgttccctcatcggcatctccgtccgcgtcgtgcgtcggcaagtcacagccgcccgccgcacacacggcgtga

SEQ ID NO: 169 - protein, 620 aa, herpes simplex virus 6A
MIYCVLSTTPGTFWFPSGFDPKPYHPSADSKLLPLGLITLSACSTRVSATTRWSSFHATDPSLSWLTGSSPWLVILQGQGGSLFCHDVLQGRLYILSHSVSLFLKTGLRHCEAIYRAPLWRDRPLPSLWTCRDPDKAFLPTLLARSARRGLAAFYALWRLHLGSRSELSHPVLEWESTELVLTDWRRGRNEAQRDAPSVAEHFARCRPLLDELCGEGGWLPFAFLSTSPHVWLILTEGGPVLAVDVNDTSVWRIADDLELLRRLGSLLLLSGLRLPLRPPSGSGEAAGEPGYEEEERRGRASTASATAATSTRGPTRPTRVTRKGRVATGGVHLSARPESEEQTDGHHGRQESSDDHQRGGSGRGHRDDGAHRHANDKTEPQQRGEHEERKQTDSGRHEHAQESQVARRDEEETEQGDSERSCGGATQTYGGRGRHDSCPSIPLSVPGPDPRLWVPPPHLLFPSPLPPMTPVDDEPSVRPRCPPGPAEEPPTCRPRPPRPSSDTPLSAVSRPSAPPVPPPSTARVRFFLSSSSSSPSYSPAPLSPPSPVSPSSPRSPFIPPIRSPGLRAKPRVSSGHPAAFPPAPSSAPARSERVTSVPSSASPSASCVGKSQPPAAHTA

SEQ ID NO: 170 - DNA, 1133 bp, herpes simplex virus 6A
  CDS (1)..(31)
  CDS (121)..(1130)
atggacactgtcattgagctgtccaaacttctggtaagtcttcagacatcattgttaccgaatattttaatgtagcgtaacatgaaaataacattcaatatctttaatagcgcaatgaagagttcaaaggcaatgcttcctgtacctcgacacccacgctaaagacagcacgaatcatggagagcgcagttaccggaatcacgctcaccacatctatccccatgatcattatagtggttaccaccatgattctctaccacagagtcgcaaaacataacgctacttcattttacgtcatcacactctttgctagcgattttgtgctcatgtggtgtgtcttttttatgacagtgaacagaaagcaactgttctcattcaaccgttttttctgtcagttagtttacttcatctatcatgcagtctgttcatatagtataagcatgctagctataatcgcaactatcaggtacaaaaccttacaccggcgtaaaaagactgaaagtaaaacatctagcacggggcgaaacataggaattctcctactagcttcctcaatgtgcgcgattcctaccgctctctttgtgaagactaacggaatgaaaaaaacgggaaaatgcgtcgtttatatatcctcaaagaaagcttacgaactgtttctagcggtgaaaattgtcttcagcttcatttggggagtccttccaaccatggtattcagcttcttctacgttatattttgcaaagctttgcacgacgtcaccgagaaaaaatacaaaaagactctattttttattagaatccttctcctgtcatttttactcatacagatcccctatatagctatccttatatgtgaaatcgcatttctctacatgccgcagaacacctgcttttggttagcccgtgtagagatactgcagttaatcattcgattaatgccacaggtacattgtttctctaacccgttagtctacgcattcactggaggcgaactcagaaaccgatttaccgcctgttttcaatcattttttcccaaaacattatgtagtacacagaaacgcaaggattcagacgcatccgaacatgatcagaactcaaaatcaaaagcgtcagtggaaaaaaaccaacccctttaa

SEQ ID NO: 171 - protein, 347 aa, herpes simplex virus 6A
MDTVIELSKLQFKGNASCTSTPTLKTARIMESAVTGITLTTSIPMIIIVVTTMILYHRVAKHNATSFYVITLFASDFVLMWCVFFMTVNRKQLFSFNRFFCQLVYFIYHAVCSYSISMLAIIATIRYKTLHRRKKTESKTSSTGRNIGILLLASSMCAIPTALFVKTNGMKKTGKCVVYISSKKAYELFLAVKIVFSFIWGVLPTMVFSFFYVIFCKALHDVTEKKYKKTLFFIRILLLSFLLIQIPYIAILICEIAFLYMPQNTCFWLARVEILQLIIRLMPQVHCFSNPLVYAFTGGELRNRFTACFQSFFPKTLCSTQKRKDSDASEHDQNSKSKASVEKNQPL

SEQ ID NO: 172 - DNA, 1668 bp, herpes simplex virus 6A
  CDS (1)..(1668)
atggcgcagtgcaatctcttttatcaatacccaattacaccaattttagaagggcatgtcagaaacatactgatttgtacagaaaaagatgtcgaaaagctccaaagtcagtcctcactaagacttcgggagaaaatagatcaagggcatcgcgacaagttgctaagaatgcgcctaaaaaccgaattagacgcactgcaaaaaaagatgcaaaaagacagtgacgttttgaattctcatttgaaagcgatagaggatgctttgctgtttacgaatgatggggaggtaaacgtcgaaacgaaagctgatgcgcaactgataccgaaatctcctgagaagctggaaaaattcaatcaggtcgctataaccccactcgacccctttataagatttacagacgattttagaggagaaatgatcaatacatttttcaataatgcccagatgtggaattttacgttcgggtcttggttctataagctcaagagggttttttacaatgagcccggtttaagaagggctttaaaacttactaatgtggattctctgactatttcaaaagagttactagcagttaccgtcaatgcgttggagcaagcgacggtgtatcctatattcggaagtgaaatgtcagacctggaagcagccttgtgtatcctggcagctttttattccacttatgagaattcacagatcgacgaacgtacaaccctagtagatgttataaccctcctgcctgtgatattcagattactcggcagtgaaattacagcattgaaaaatgtctctccttctggcacctattttggatttaatgatccttcttgtatgaaattttttgttcccatgagaaaaggcaagcattatgcagaaaacacattcgggaatcatgtgcttataaagatgttgctaggtagaggggtaatgcaaaaaattcccggtgagaaaattagccaaaattttgatgttgaagctcgtttacacggggccattaagaatgatgttttggtgtattggacatatcagctaatgaggccaaaattgggaaataatgttccaatcttcatacacgatcaacattatttacggtctggcttggttgcaattgaaagtctttttttattgtggcggatcctgaactcagaaagtttgtttaacaagagagttgggaagtttctcttaacttcgatttttccacagttggagaatgtcgatttcgccgaaaataactttgaagctggaaacattcaaaattttgaatacttaatgcaccattacgttgtgcctatgtacaacctgcagaatgacatatcaatttcgactctttttcccggtctcgtggccgtgtgtgtaaatgagagtgtgagattgggatgggaacataagtgtgcgggggctccgtccgatgccgttcaggttcaatctaaggaaaatccgttcgtggagtatatccgcgctcaaatggaacaacaagcggatgtggcgatacttgaaaagcatgactgcattctctttcatcttgaaaacggtttaaacatcactctatcttttacattaccgagacagagattgtttgcaatggcttcttcattatttaatgtaaatgatacttatgatttcatctattttctagttttgggttttctgccaataccggccgttatataa

SEQ ID NO: 173 - protein, 555 aa, herpes simplex virus 6A
MAQCNLFYQYPITPILEGHVRNILICTEKDVEKLQSQSSLRLREKIDQGHRDKLLRMRLKTELDALQKKMQKDSDVLNSHLKAIEDALLFTNDGEVNVETKADAQLIPKSPEKLEKFNQVAITPLDPFIRFTDDFRGEMINTFFNNAQMWNFTFGSWFYKLKRVFYNEPGLRRALKLTNVDSLTISKELLAVTVNALEQATVYPIFGSEMSDLEAALCILAAFYSTYENSQIDERTTLVDVITLLPVIFRLLGSEITALKNVSPSGTYFGFNDPSCMKFFVPMRKGKHYAENTFGNHVLIKMLLGRGVMQKIPGEKISQNFDVEARLHGAIKNDVLVYWTYQLMRPKLGNNVPIFIHDQHYLRSGLVAIESLFLLWRILNSESLFNKRVGKFLLTSIFPQLENVDFAENNFEAGNIQNFEYLMHHYVVPMYNLQNDISISTLFPGLVAVCVNESVRLGWEHKCAGAPSDAVQVQSKENPFVEYIRAQMEQQADVAILEKHDCILFHLENGLNITLSFTLPRQRLFAMASSLFNVNDTYDFIYFLVLGFLPIPAVI

SEQ ID NO: 174 - DNA, 1053 bp, herpes simplex virus 6A
  CDS (1)..(1053)
atgaatgtactcgtggccgacgaatggttcgattgcgcgattaggttagattcggaaaccatagctgtccatgagattttcaatccggagttaagtaaactgcttaacttgcactcgaaaacagtctacatgtccgacctatgcgcttttatttctggttgtgttaatcggaatgtcggtaaacttaccatatattggcatgtgaacggagatataatctacgcattgacgggtattttacattgtgtaaaaataaagatagagtgcggggagagaattgccgatggtcgatatagattatacgaaattcctaaattatttttaatgagaggacagtcaacacccatggaattgaagtggaagcacgccgtgggtatcgcgacgacgaataagcctttgctgacgcacgttttaacagatgtgttggaaacatctccttttaccttgccagatacgcttctgtcggtgcaggagttgtctattttcagagagagattgtcgtacatttactatgtgctggggtcagatgttgatatcgtagcgcggacagagagagagatttttcaaaaatgtgcagaactagctcgcctacagcaagtgttccttattcaaggaaatattatggaaaactttgtcctcgcccaggcttgtctatttcagctgggggctgatggtttgtgggaagagatatctggttctgtacgtcctaggccggaattgatgtccagtgcgttcattcaacacagagtaatgttgaataattgttattgtatcgctgtcatcttcaatgccatttacaaacacaaactttccctgcctaccgtagaaagaagccacgaaaccgttaatcgtgtagctcaggaatattataagtcttatgtgaatgctcctctctctgttcttgtgtgtgcgactaaggtgcttactttatttacagaagaatataactttaagtcagctctcgtatttgtcagtcagtttttccaggtggacgtcgaggcttcgagagcggatgtgattcgtctgtttttagcgtgtctaaagggtgattaa

SEQ ID NO: 175 - protein, 350 aa, herpes simplex virus 6A
MNVLVADEWFDCAIRLDSETIAVHEIFNPELSKLLNLHSKTVYMSDLCAFISGCVNRNVGKLTIYWHVNGDIIYALTGILHCVKIKIECGERIADGRYRLYEIPKLFLMRGQSTPMELKWKHAVGIATTNKPLLTHVLTDVLETSPFTLPDTLLSVQELSIFRERLSYIYYVLGSDVDIVARTEREIFQKCAELARLQQVFLIQGNIMENFVLAQACLFQLGADGLWEEISGSVRPRPELMSSAFIQHRVMLNNCYCIAVIFNAIYKHKLSLPTVERSHETVNRVAQEYYKSYVNAPLSVLVCATKVLTLFTEEYNFKSALVFVSQFFQVDVEASRADVIRLFLACLKGD

SEQ ID NO: 176 - DNA, 651 bp, herpes simplex virus 6A
  CDS (1)..(651)
atggagttgccgcgaaaatacgacagggtaacgggcaggatattgacacataagaataaccagatgtgtacaaccgaatgttctcagatgtataatttacacaatcctatcacgtttgagttgggacttggaaacgtgtttgtctgtatgcggtgtttgacggttcaccactgtgatatgcaaactgactgtaccattgtcaacacgcatgaggggtatgtctgtgcaaaaacgggtttattttatagcggttggatgcctgcatatgcagactgcttcttagaaccgatctgtgagccgaatattgaaacggttaatgtcgtggtggtcttgttatcttatgtatatagttttttgatggaaaacaaggaacgatatgctgccattattgatagcattattaaagatgggaaatttataaaaaacgtggaagacgctgtgttttatacttttaacgcggtttttactaactcaactttcaataagattcctctgacgacgataagtcgtctttttgttcagttgattataggaggacacgctaaaggaacgatttatgacagtaatgtaattcgcgtcagtcgtcggaaacgagaagacagtttactaaaaaagatgagattggagtatggaaacgcacttatactatga

SEQ ID NO: 177 - protein, 216 aa, herpes simplex virus 6A
MELPRKYDRVTGRILTHKNNQMCTTECSQMYNLHNPITFELGLGNVFVCMRCLTVHHCDMQTDCTIVNTHEGYVCAKTGLFYSGWMPAYADCFLEPICEPNIETVNVVVVLLSYVYSFLMENKERYAAIIDSIIKDGKFIKNVEDAVFYTFNAVFTNSTFNKIPLTTISRLFVQLIIGGHAKGTIYDSNVIRVSRRKREDSLLKKMRLEYGNALIL

SEQ ID NO: 178 - DNA, 1008 bp, herpes simplex virus 6A
  CDS (1)..(1008)
atggcgatatcgactttttcaattggcgatttgggttatcttagaaattttctgcagaatgaatgtaactggttcagaatttgtaaaaaaacattctatcgcgaatatcgcagcgttgcgacatcgtctcctacattctcgttgaataataagcctaagaaattttgcatgcattgcgagattgtaatattcaagcgaagtgaagaatttatgttcagccttgcggtaaatggcatacattttgggcagtttttaaccggaaaaatgaaatttaataagaaagcagttccggaagggctctattactatatattggaattgggaagcataacccctatcgatttgggctttattccgagatataattccgactgtgttacaaacatgcgttgtgttacaccggaggttatttatgaaaattgctctattgtgtgtcccgaagaggcaaatcgcctcacggtaaaagggtccggggacaataaattgactcccttaggtgggtgtggagcatggtgtctgaaaaatggtggcgatctgtatatctatacttttgcactcgcttacgatcttttcctaacttgttatgacaaatccacctttccatctctggcaaaaattatttttgatatgatagcttgcgaatccgaagattgtgtcttttgtaaagatcacaacaaacatgtatcgcaagctggacagattgtagggtgcgtctctaatcaagaaacctgtttttgctacacatcgtgtaagaaaaaaatggctaatattaacaatccggagttaatctctctgctctgtgatcaggaaattaataagatagatattatgtatcccaaaataaaagcatcgttatcactggacattaattcttacgctcatgggtacttcggtgacgacccttatgcgttaaaatgtgttaattggataccagtcaggatcagcgcagctctgagcaggctgattgttttgtcgtgtcctgtgtgtaagcgtgtggtaatggactaa

SEQ ID NO: 179 - protein, 335 aa, herpes simplex virus 6A
MAISTFSIGDLGYLRNFLQNECNWFRICKKTFYREYRSVATSSPTFSLNNKPKKFCMHCEIVIFKRSEEFMFSLAVNGIHFGQFLTGKMKFNKKAVPEGLYYYILELGSITPIDLGFIPRYNSDCVTNMRCVTPEVIYENCSIVCPEEANRLTVKGSGDNKLTPLGGCGAWCLKNGGDLYIYTFALAYDLFLTCYDKSTFPSLAKIIFDMIACESEDCVFCKDHNKHVSQAGQIVGCVSNQETCFCYTSCKKKMANINNPELISLLCDQEINKIDIMYPKIKASLSLDINSYAHGYFGDDPYALKCVNWIPVRISAALSRLIVLSCPVCKRVVMD

SEQ ID NO: 180 - DNA, 345 bp, herpes simplex virus 6A
  CDS (1)..(345)
atgtctttgaaggactatctgagacagtccatttctaaagatttggaggtgagacatcgagattctttaaagattagattaggggagagacatccattgagtgtgcatcagcatatgatcgccgctaggcagatcatcaaatcggacaatgcagaacaacagcatgtaatatcttctttgagtggttttttggataagcagaagagttttttaagagtgcaacaaaaagctttaaagcagctagagaaattggacgtcgacgaaataattgatacggcagcggaagtgaaagcagtcagtaatgatataaaagaaactcttataacaagcactgaattagaataa

SEQ ID NO: 181 - protein, 114 aa, herpes simplex virus 6A
MSLKDYLRQSISKDLEVRHRDSLKIRLGERHPLSVHQHMIAARQIIKSDNAEQQHVISSLSGFLDKQKSFLRVQQKALKQLEKLDVDEIIDTAAEVKAVSNDIKETLITSTELE

SEQ ID NO: 182 - DNA, 234 bp, herpes simplex virus 6A
  CDS (1)..(234)
atgggcgcaaagtgctgtaaaccagtatcttgcggcatgtgtaagaaaaccgaaaacaccttgattgattacaagggaaatcctatattactagcgaatgaatttactgttttaaccgataccgaatcggaagaggaagggatggcagatcttgaaaagcccttacttgaaaaagtagttgctaagtgtgatacggaagctgaaaaaaaattgccttgtaaatcaaaaaaatga

SEQ ID NO: 183 - protein, 77 aa, herpes simplex virus 6A
MGAKCCKPVSCGMCKKTENTLIDYKGNPILLANEFTVLTDTESEEEGMADLEKPLLEKVVAKCDTEAEKKLPCKSKK

SEQ ID NO: 184 - DNA, 1989 bp, herpes simplex virus 6A
  CDS (1)..(1989)
atgcatctccgggggtgtgcgtgtcatcttagcctttattgtgtgtacaatgactgggagaataagatctacagagtaccgatttttcagtgtctgtttttagaagcggagactcgttcgttaaaaacgtttttgattaggggacagagcctagaccaagaatcgttaaatgagatagaagttacaagaaaagaaacaatgctttgggaccttcaggaacaaagtaatatgatggacaaaaaaatagcagcaatcagcaacctcattatgaataacggagagcttgttaggacactttcaaaatttttcgtgcctctaaccgttgttcttggagatgacgggttagagattttggaagcatacgtttgtggcgaggaactcatgttgcctctggacacggtacctgttatcttacggtgtatcggagactacgcggccttggacacgaagcatcttttgagtaacgaatgtacacaggcttccaaaaaaattcgctttggatacagtgtgatggactttcacttttcgctgactgtgtctgacgtgaaaatttgtttttcacacacggacaccggtgaggccgtatgtgaaaaaatgaaacaaattttttctttttctgtgtgtgctttcggcggtgagcaagttctcttagtgacgccaaaaaatgcttatgccttattgttcgacgatgatttgtgtttgcttttactgcagagcgtgtttgctttcctgcacgagaagatattcggagtttataaacaggtattagttcagctttgtgaatacatcggtcccgacttatggccctttgggaatgaaagatcagtttcttttataggatatccaaatctgtggcttttgtctgtatcggacttagaaaggcgagttccggatacaacttatatctgccgcgaaattctttcattttgcggtttggcgcctatcctgggacctcgtggtagacacgcggtccccgtagtcagggagctaagtattgaaatgcctggaagtgaaacttctttgcagcgtttcaggttcaatagtcagtatgtttcaagtgagtccctgtgttttcagacaggtcccgaggacacacatctattctttagtgacagtgatatgtatgtagtgactttgccagattgtctgaggctattattgaagtccacggttcctaaggcctttttaccatgttttgatgaaaacgccacggaaatcgatctgcttttaaaatttatgtcaaggctgcaacacagatcgtacgctttattcgatgcggtgatctttatgttagatgcttttgtttccgcttttcagcgagcatgtaccctaatgggaatgcgatggctgttagtgcgggacttacacatgttttatttaacctgtgatggtaaagatacacatgttgtcatgcctttactgcaaacggccgtagaaaactgttgggaaaaaactacggaaatcaaacaaagacctacatttcagtgtgcggaaatttcgcgctgtggatttatcgtctacgccagattttttttgagcagtgggttgtcacaatctaaagaagcgcactggacagtaacggcgagtaaatatttatctgcatgtattcggaccaataagacaggtctttgctttgccagtataactgtttattttcaggatatgatgtgtgtttttatagctaataggtataatgtttcttattggatcgaagagttcgatcctaatgattattgtctggaatatcatgaaggacttctggactgcagtagatatacggccgtgatgtctgaagatggacagcttgtgagacaagcacgtggaattgcgttgactgacaaaataaacttttcttattacattctcgttacactgagagtgttgaggagatgggtggagagtaaatttgaagacgttgaacagacacagtttattaggtgggaaaacaggatgctctgtgaacacattcatttactgcatttgaattaa

SEQ ID NO: 185 - protein, 662 aa, herpes simplex virus 6A
MHLRGCACHLSLYCVYNDWENKIYRVPIFQCLFLEAETRSLKTFLIRGQSLDQESLNEIEVTRKETMLWDLQEQSNMMDKKIAAISNLIMNNGELVRTLSKFFVPLTVVLGDDGLEILEAYVCGEELMLPLDTVPVILRCIGDYAALDTKHLLSNECTQASKKIRFGYSVMDFHFSLTVSDVKICFSHTDTGEAVCEKMKQIFSFSVCAFGGEQVLLVTPKNAYALLFDDDLCLLLLQSVFAFLHEKIFGVYKQVLVQLCEYIGPDLWPFGNERSVSFIGYPNLWLLSVSDLERRVPDTTYICREILSFCGLAPILGPRGRHAVPVVRELSIEMPGSETSLQRFRFNSQYVSSESLCFQTGPEDTHLFFSDSDMYVVTLPDCLRLLLKSTVPKAFLPCFDENATEIDLLLKFMSRLQHRSYALFDAVIFMLDAFVSAFQRACTLMGMRWLLVRDLHMFYLTCDGKDTHVVMPLLQTAVENCWEKTTEIKQRPTFQCAEISRCGFIVYARFFLSSGLSQSKEAHWTVTASKYLSACIRTNKTGLCFASITVYFQDMMCVFIANRYNVSYWIEEFDPNDYCLEYHEGLLDCSRYTAVMSEDGQLVRQARGIALTDKINFSYYILVTLRVLRRWVESKFEDVEQTQFIRWENRMLCEHIHLLHLN

SEQ ID NO: 186 - DNA, 597 bp, herpes simplex virus 6A
  CDS (1)..(597)
gggacgaaccgagaaggtctatccaatgaagataattatgggaattttcggcttaataagtctttagaacagcttagggccaaacttgttgcaagcagcggcgacattgtagaaagatcgcttttgaaattgaaagagtgtttggataatgtaaaggataatttaataaaaaatgaatgtgctgatgttactggtccaagtaaatgtttaagtaaaacaaaacatatcgagccaaagaaacagatagtgttttctgattgtgtcaggccggtacccgtgtgtgagattaaaccgtttatcgatgtgcgactatttgaaacggcgcggagcccaagaagacttcgacaacggaccaggacaatcgtcggatcaacagatggtgcgatcgagcaacagcgtgttatttcgggacaaaaccgaggcagagcacgaggacgtggccgagggagagctcccaggagacgaaattccaatataaataattcaaggacacaaactacaattgttatagacgatagcagcgaagccgaaaactttgaaaatgaggggagttttaatgaagatttactggcaaccacaatattggaaacactgtaa

SEQ ID NO: 187 - protein, 198 aa, herpes simplex virus 6A
GTNREGLSNEDNYGNFRLNKSLEQLRAKLVASSGDIVERSLLKLKECLDNVKDNLIKNECADVTGPSKCLSKTKHIEPKKQIVFSDCVRPVPVCEIKPFIDVRLFETARSPRRLRQRTRTIVGSTDGAIEQQRVISGQNRGRARGRGRGRAPRRRNSNINNSRTQTTIVIDDSSEAENFENEGSFNEDLLATTILETL

SEQ ID NO: 188 - DNA, 1863 bp, herpes simplex virus 6A; identical to SEQ ID NO: 168
  CDS (1)..(1863)

SEQ ID NO: 189 - protein, 620 aa, herpes simplex virus 6A; identical to SEQ ID NO: 169

SEQ ID NO: 190 - DNA, 159321 bp, herpes simplex virus 6A
  CDS (3918)..(4355)
  CDS (5110)..(5688)
  CDS (7751)..(8182)
  CDS (8885)..(9454)
  CDS (9556)..(9837)
  CDS (9931)..(10581)
  CDS (11245)..(11514)
  CDS (12382)..(12681)
  CDS (16456)..(17928)
  CDS (20198)..(20791)
  CDS (20830)..(21273)
  CDS (23374)..(23658)
  CDS (23712)..(26231)
  CDS (31186)..(33333)
  CDS (33469)..(34341)
  CDS (34369)..(35397)
  CDS (35917)..(36669)
  CDS (36745)..(37512)
  CDS (40284)..(40613)
  CDS (45914)..(46663)
  CDS (51010)..(52044)
  CDS (56836)..(57753)
  CDS (61066)..(62034)
  CDS (65410)..(69447)
  CDS (69449)..(70339)
  CDS (70519)..(71817)
  CDS (71895)..(73271)
  CDS (75048)..(75824)
  CDS (79204)..(81288)
  CDS (81455)..(83410)
  CDS (84104)..(85234)
  CDS (85917)..(88499)
  CDS (88724)..(90268)
  CDS (91702)..(95100)
  CDS (95108)..(97288)
  CDS (99734)..(102772)
  CDS (105069)..(105389)
  CDS (106187)..(107599)
  CDS (107601)..(107867)
  CDS (116966)..(117865)
  CDS (117888)..(120302)
  CDS (121513)..(122400)
  CDS (122508)..(123458)
  CDS (123475)..(123648)
  CDS (123667)..(123930)
  CDS (124237)..(124947)
  CDS (124975)..(125583)
  CDS (125681)..(126982)
  CDS (126985)..(128253)
  CDS (128504)..(129673)
  CDS (129933)..(130814)
  CDS (132206)..(133063)
  CDS (133330)..(133662)
  CDS (137744)..(140356)
  CDS (141770)..(142084)
  CDS (142231)..(143301)
  CDS (143386)..(144414)
  CDS (144774)..(146108)
  CDS (146230)..(147837)
  CDS (148046)..(149167)
  CDS (149506)..(150606)
  CDS (150890)..(151855)
  CDS (155151)..(155588)
  CDS (156343)..(156921)
  CDS (158984)..(159319)
tcacgcgtctcgcagcggcgcgcgtgttggtgaaaaacacggcgcctcccatagcggcgtgcgcgcgcgcgttgggggatgggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagccggtggtttcctttggcaccgtgccaggccaccgtgggtcccagacggtggcacgtcgcgcgcgatgtcgttttgaattgtcttcacgtctcaccccggtatgccccatctacgtacccacccgcgactaccacatgggtgggttgtgcgtgtctgtgtgtctgcgtgtgtacgcgtccgtggtagaaacgcggtgacaacggattacggaggtgaatgttgcggtggttgggacggggagggagtgaagagatgtttcccgtataggtgtttttggaacgtggttttttttttcttacacttgccatgctagcgatcgccctctgtcttcggtccgcgttaccgtgtcgtgtgtacttccgcatacttttgtctctgcgcctcgatacaccccgttgattggatgatcgccacatgtgtattggacgtcacagtctgctatttttttcactgtctatttttaaacctgttgtcgtcttcccgccaaggctatgtgtctccgccttttcttatatttttctgacgctgttcgttttctacgttcgcctccaatcccggacgcacctcctttgtatgttcactcctcccaccccccggggtgcctatataagaagcgaacgacgcgctttcaagcagtcccgatctatgtgactcaccctgtcgcgttggcatcgggcgctgctatagcgactacgctatagagcggcggtgcatcacggccgacacatacgtttttttggttacctgccatcagtaacacggagcgtaagcaccctgtgtgtgactgtctacgttcgtggattttatttttcgtggggttaaagggaagagggaaggaaaacgagtacgcgcaccgatacgcaccccacgcatacacaccccacacaatgcatgattttctccggtcacgtctctggccgtaggtgacatgcttacttcacctccgtggcgtctaatccaggtacgctctcttcctcggaagctttccactgcggtctcacgtgttcgcacagtggccacgcgtccccggggagatgtctacccggggccgagtacgtccagtgtcctctcatggcccgcggtcccatcttccataaggtggaaaacgagtttgccagacgacagatcttgccggtatcgggccagaacgctaacagaggtcccgccaaagtcaagaccacccaagcgatctccacctcgcgtggccccggcgttggtacgtttcccacagtcgtacgtatcggaggcgacggcttctgcgtctccctctctcgagagagaacgccgcacacgagccacggtcccagggggtggcccgcgtacaggtgccggcggaggtctctccgggcttcgggccataaccggtactgaacctgcggcacggtcagagtcatgcgcgcggccggaaccgccgtccacggatctcccacggtctctagtaagttgcaggacactccggcgtgcgtctgacacaggccgccgacggtcagcaggttgtgttcgtcggcggccgcggcgatcacgtcgaacagatgtcgggcgttcgttccgcacatacgctggtccggcagctctaggtcttcttcatacgtcacggcgtcgcgttgcagccctcgtcttgtaaactccgttgtgctcgacgccagtcggcagagtcttgccgccctcatgtggtggacgtacacggctccgtctttgcccaccaggagcacgcggagcgtgtcgagctgggagttggttacatacgactttacgaaacccacgggttgaagtttctctccgtatccgcaacatacgtacagacaggagtctagggctgtgatgggacgcgcgtacgtcaacgattgaacatgatggatccggccgacacgatagaagaggcgtttaacccaaacaaaacaacaagaaaccataaacgttatggtgggcgttgccttatttttgtctgtggtctctgaccgtataaaaaaagcacagaacatctgcacacgcaaaggcatcccgtggaacgggagatgccgcatacagccgtggtcgctatgcccttgtggagtataacggattcgtatcctgtcgcgtacaattcaaagcgaaaagcacacgcgacaggaatggtgactaatgcgaggatgccataacgcagaaaaaaggaggagctgtaatctttcttttgtgtttttttttaccgttataggagattacaacaaagaggtctcgcgtaaacgagacaggatatccgtaatcaccgtgttccggaagttataccgcctgtaccatcgttaatggaaagtacctctgcggggattcacggataccggattgtggataaaaaaaatcacaaaaaaaatacaataactggactccactccgcgagtcgtctctggggccggaggccgtcatcggctttactgccttacgatccggcgcgtcacatacttgactatgtttcgtctcccctcctcgtattcatactcgttttccgttactcgccgcccctgacgtgacgttttttttttgtccccactctctaccggctggtgtctctggtggttctcgacgaaccttgtactcactcactgtctgaccgacatccctccccgcggctcgcccgtacgtttactcaccgcagtcttgaacgcatctgggtctcacgtgcgtcgctggccaaccccagcggtggccccacacggtggcacttctggcgtctctgtacggatcgtggtggagttctagacaccagcacggcggccacggtaggtggatcagttctccgcgatgccggctcgcatagccgtacagtttggacggcctgccgcgggccaggagcagccagtcgaagcgggcacgggctcgcgcgtgggccagtctcgcctcgttgcgccggaccgagatgcgtccgcccgtcctctgtgtgtgtcgcgtcgacatggctttccgaatgctgtgtgaataacggacgggtttttttttttgcctgttcttctgtccttatgtgggacgggggcctctctttcactatatttatgttatttttttttttaatttgccgcccgcgatgtcgatgtggcaaggtgtttgctggtctgtgacggggaggggtggggagataaacaagaaacaggcaaaacagcacgtatgcgatgtagtcagtgacactgtcgatggtggagcggctcggtaaaaagtgacagacagaacccgtgtcggtggagatatatcataggagcgcggaaataccgcgtgattgaagggtgacggcggaccgcggtgttttctgcggaaccgacgtcgcgacgcccccgggggaaccgcgtctgcggaccccgatgtcaacgggccaatgtgtcgcgtgtcgcatctccgggaatcgccggggacgtcacgtggaaaaatgtttaaccgcgaaaatcacttttacctatgtattttttgtttttttttgtctaccgggtgtggaaggggatgagggcggggagagggcatgaggacgagggcgggcccgagcaaacagtctcgcgataatttgggattgcgcgtcgacttctcgttctttatgcccgcgtacgtcggggtcttgtctcggctttgccgccgcggcagggtctgcgccggcccgtcgcgagctagggacagggggtgtgacggcaactgtgccctgttgcggtttcgcaacgagggggtgcgtcctataggcgcgcgtgggaggggccggacgtatacgaagggtggctcgtctcgaagtcccgcctcatgggcggaacaagggagaccgccctttacgctttcggtttcaggtaccgtcctgtgcttaggtcgcgggctacctgctgtcaggaaggccggattctgccggcgtgtgtccgttcatggatatgtggcatttggcacttacggaaaggggacgtacggagaaggatgagcgtttggccggtgtttagcctttattctgtttttattttataatacactattatattgtatatttttttttattttttatttccacgtactattttttttttatttacaaaaaacctttaactttttgcattcggtactcttttcgtacggcgatgatctcggcgccggtggtacctgtcgtcgcctccccgggtgctccgccacgactaccgtgacggcgacaaccgccgccgccgccgttactgtcgctgttcggagaacgtggccgttacagtttccgctgccgctgcggtcgccgcctctgcggacggagtcggcgtgtgtgctccggggagggggatgggaggggttggaccgaggggacaggggaggagcgttgccgtagaggcgtccgagggactgcccgtcgacgcgcctgcgcgactcgagcgggggtgggagggaaggtggatgggccggcgggcgttcggttgtggtggtgtgttttttttttttattgtcatcggtcgcgtccgtgtgaactggcacgagtgagatgacttgtttttatcggggcggatcgggcgaggggcgcggagcggatccgcccctcgggtgattttacggactggcgtgtggaccgtgctcggggagggcggatagtaggagtgggtcgatcgtttcgtcccgctgggttttccttgttacggtacgcgcgcacacactcccgctaaaaccgggacgtgcacgggctccgttacctccggcggtcgatgtctggcgtgttgtcgtgcgtgctccgcgcgtgtgcgtgcgccggactctgctgctgggtgtgtatgggggcgatatgcggaggttgtcagcggtggtggcggaggcggtgcgcgaggtgggggcgtgtcggacctcgggtccgaagcggcgacggagcccgctgggtatcgcggaagtgcgagaccgagcgggctccatccgccgctcggtccccggcgtgttcccctcattttgttctcgtatcttcttcctcttcgtcttcgtgttcttccgcctgttcttcccgtcctctttcgtcgcctccgtcacctcgcgcggcgtctcacgccgtgtgtgcggcgggcggctgtgacttgccgacgcacgacgcggacggagatgccgatgagggaacggacgtgactctttcggaacgggccggcgcggacgagggcgccggcgggaacgccgcgggatgcccggaggacacccgcggtttcgctcggagtcccggagatctgatgggggggatgaacggagatctgggagacgagggagagacgggagagggcggagacaacggagcgggagagtaggacggggaggaggaggaggaagagaggaagaaacggacacgcgcagtggacggcggggggacgggcggagcggaggggcgcgagacagcggacagcggggtgtcggacgacgggcggggcggacggggacgacacgtggggggttcctccgcgggacctggcggacaccgagggcggacggacggctcgtcgtcgacgggcgtcatcggtggcagaggggaagggaataacagatgagggggagggacccacaggcggggatcgggcccggggacggacagggggatcgacgggcaggaatcatgtcggcctctgccgccgtacgtctgcgtcgcccccccgcagctcctttcgctatcgccctgctccgtttcctcctcgtctcttcttgcgacctggctctcctgtgcgtgctcgtggcgcccggagtcggtctgtttcctttcctcgtgctctccgcgctgctggggctctgttttgtcattcgcgtggcggtgcgcgccgtcatcgcggtgtcctcgtccgctaccgccgcgctggtggtcgtcgctgctctcctggcgcccgtggtggccgtctgtctgttcctcagattcggggcgtgcggagagatggacgcctccggttgccacacgccccttacgcgtcacccgtgtcggacgggtcggtccgcgcgtcgacgtcgcggccgtcgcgctcgccgtcgacgctctccctcttctctcttcctcctcgtaccccggctctccggccgcctcgccgctcccgctcgggggacggagaggaagccggaggcctgagaggaggagcagactccccaggcgacgcagcagctccaggtcgtccgcgatgcgccacacggaggtgtcgttcacgtcaaccgccaggacggggcctccttccgttaggatcagccagacgtgcggagatgtggagagaaacgcgaagggaagccatccgccctctccgcacagttcgtccagcagcggtctgcacctcgcgaagtgttccgcgacgctgggcgcgtctctctgtgcctcatttcgcccgcgtctccagtccgtcaggaccagctctgtgctctcccactccaacacggggtgggagagctccgagcgcgatcccagatgcagtctccacagggcgtagaaagcggccaggccgcgtcgggcgcttctcgccagtaatgtcggcaagaaggccttgtcggggtcccggcacgtccacaggctcggcaggggtcggtcgcgccacagcggtgcgcgatagatggcctcgcagtggcggaggcccgtctttagaaagagcgacacggagtgcgacaggatatagagtcggccttgcagcacgtcgtggcagaacagagaccccccctgcccttgtaggatcacgagccaaggggacgatcctgtcagccagctgagagacggatctgtcgcgtggaagctgctccagcgtgtcgtagccgacacgcgcgtggaacaggcggacagcgtaattaggcccagcggtagcaacttgctgtcggccgaaggatggtagggtttagggtcgaaccctgagggaaaccaaaatgtacccggtgtagtagacaaaacgcaataaatcatgtgaaaaagtggaaatgtatatgacactcacatagagaagacttcgtaggccagccctgaagaagatgcggttgtcttgttatacaggggtaacgcaggagacacttgtaaggcttaggatgtaaatgtaggcattcctgctcgggccaaggtaaaggaatgcgtagacccttgtgcagacgcaggtaggaatgaacatgacgaagggaatgtcgacccaagagtagccaccaataattggagagcggaagacgatatggcgcgtgcccggcacgcaccgttagcggcatcctagagtaagaatagaggggcggacaagtgtagaaacaagcggggcgagatggaggaagaaggtgaagttgaagcggcagggggtgatggtgtgaaagaggggcagcgttaggtgcggatgcgaggattagtgttagggttgtgaacagagttatgcggttatggctagggttatgactaggggtatggctagggttagtactttggctacggttagggttagtactttggctagggctaggtttagtgttagggatagttttatggttagtgttatcgttggtgttagagttagggttgatgttttggttagggttaatgttttggttagggctagacctagggttagggttagggctagacctagggttagggttagggttagggctagacctagggttagggttagggttagggctagccctagggttagggttagggttattaccccccctttttttagcccccccgggggatttgacgtaatttttaaaacgcgaggtattccgtctcccggagaaacggtgttggacaaaaaagtgtcccggccctggcgcggtctgacctcgcgccgcggggcgacgatgatataggaaaacgaaacaaaaaaggagtctcggcccgagcgcactccgactcgccgctgcagaaaaacggcagctatatggcgataactgttccggtccgggtacggtccggctgagcggagtggagatagaccgcttttatgagaacaagtgacccggccggagtgccgttgagtgcctcagaggtgagtaggagaggccggagaaacgggtaaacgcgcgccggtgcgcgcgttgtgtgataagtgctgcaacgggcgcggtcataaacagacagaggaagatagcagaatagagagaaagagataaaaagagaggaaagaattacgcagacttaatatctgaccaccaaaacgacagtctacacacacgccggttacggaaaagatgagcgtcagagtactgatcgccatttggcgatcagatgtatttttcttcgctatcgttttataccgcctccctctccgctttatattgccgcagatgaacatgatcggccccgactcatcttcgagtccgctgttcgacaacgatacgccgcacgatctttccaccgaggtgtgattttagaaggtagagtttgaacactacgtgtctcagtcgcacacggtacaggactctgaacgcgcccgacgttgtcggtagccatatataatttttgtgcactctctagttgcattaatttgtcatggcttttgattcacgcgaatgttccccgacgcgaaccgtttaattattgtctgccgtcgtcataggatctgtttcgcgtttgttctcgtctatagtctatttaacatcatcttcctttactccttgtcctgtttgtctcgcgcatacgaaattttcacaagactgagacgaagaatggcaaccgcaaggctgagcgctatgaaaccgccgagatcttgtgcgctgatatttttgtgcgcgttttcgatggcgacggccccaacgaacgctacggcccaccgacgtgcgggaaccgtgaaatccacaccgcctccagaggataaacatagctataccgcaaaatactatgacaaagacatttattttaacatttacgaaggtagaaattctacgccgaggagacggacgctatcggaaatcatttctaaattttctacctccgaaatgttaagtttaaaaagagttaaagctttcgttcccgtagatgaaaacccgactactaccttagaagatatagcagacatcctgaactacgctgtttgcgatgacaatagctgcggttgtaccatagagacacaagcacggtaaggatgcagcgtttcatttcatcttgtttattcgatgtcggaatctactgagatcataaataaatgaatagataataatcatatttaatttatcgcagcatcatgttcggagatatcataatctgcgttcctctctcggctgacaacaaaggagtgagaaattttaaagatagaataatgcctaagggtctatcgcaaattctctctagtagcctaggccttcacctgtctctgctttatggcgctttcgggagcaactataatagtttggcctatatgaggcgcttgaaaccactgaccgcgatgacggcgatacgtttctgtccaatgactactaaattagagctacgccaaaactacaaagtgaaagagactctatggtgagtacctgtacaagtttgtgtgcctttgtatcacgtctcctttattgccaaggaaagacatgcattttgtatttatcgacctaaaaaagtgtaacatcccagatacataaacaccccgagtttactaaaaagagtcccatctatacaccctgccgcgtcttcggatgcacctgttactctagaaacgttgcactacttgtcttacactctccactctacccccccccccccccccttagaagacagaccacacccctgtacgcgcatacgtatcaaccccgcacgcatacctacatcctttcagagtagaaactatggggctggaagccttcgtaatcataaaattttttctcgttccccatgtcttgcctctccgtggggcacacatgtatttattcactcaagtgaactgatcgtcagtatcgagattttgaaaatacgaaacaatggcggacagactatgaagacgttaacctcgtttgcgatcgttcgaaaagacaacgacgggcaagattgggaaacctgcacgcgctttgcgcccgttaatatagaggacatattgaggtataaacgtgtcgctaatgatacgtgttgtcgtcaccgagacgtgcagcatggtcgtcgtacgttagaatcttctaactcatggactcagactcaatatttcgaaccgtggcaagatatcgttgacgtatacgtgcctataaacgatacccattgtccaaacgatagctacgtcgtgtaagtaatttcagtcaattttactaaaaaagcaacatttatgtttcttattagctttgccacatacaggtggaacacaattctaaaattgtaattttgaatttcgttttttgtcaggtttgaaacactgcaaggtttcgaatggtgttcacgtttaaataaaaacgagacgaagaattatttatcttccgtactgtaagtaagctcattttctcttttttttaatgcaagtttgaatttatactgtgtgcgatgtatcgtttgagattctttaacttatgtttctaacagagggtttagaaatgcactgtttgaaactgaggaactgatggaaaccatcgcaatgcgacttgcctcacaaatattgtcaatggtcggacagcaaggaacaactatacggtgagtttaaataacaggggattggtaggaacaaattttttggagtaatcttttatgttaattttttttccgattttccggttatgcacagcgacatagatcctgccatcgtaagcgcattgtggcactctttgccagaaaacctgacaacgactaatataaaatacgatatagccagtccgacacacatgcgtcccgcattatggtgagcgctgtttacaaaagatcgtaattaaataaatgacttttccggattttttttatatttatgcagtttttcttaatttgcagcaccatatttgtacagaccggaacttcaaaacaacgttttagaaatgcgggattattgatggttaacaacatcttcacagtccaagggagatatactacacaaaatatgttcgaaagaaaagaatatgtatataaacacctcggacaagctttatgtcagggtgggcacgtattttacaatccgaaagaagtaaaatctgaaaacatcaaaatgataaatataaaacctactgtcgtgaggacctgaccgttatgtgcgcgtgttagaatgtatacgccttgggacatgtatattttcctgttgtgtttacatatacatttgtacactttatcgatgtagataaatataacccccgataacttttgttgttttttggaatatataaatagtgcgttatcgaccatgtgtatattgaattgtatatatagctgtaaatattcatattatatttaaatgaagataaaagaatcattgtttgaataacaaactatattgctgctagataattatgcatttcttggttgtgtatattttaatacatttccatgcatatcgtggaatggctgcgctaccgctttttagcacgttaccgaagattacttcgtgctgtgatagctatgtcgttcttaactcatcgacttctgtctcttccttgatttcgacctgcctagacggtgaaatgtaagtatcgttcgatttactcggggaaaacgtcacctcgggtaaacctgaatgattactataccattttatcgtgtgtgcatgtggatgtatagtctgagtaataacacaggacatcgccggttaatttataacttgatatttgttcagtctgtttcaaaatgaaggccagaagttttgtcgacctctcacggacaatagaacaattgtatataccatgcaagaccaagttcaaaaacccttgtccgtaacgtggatggatttcaatctagtcattaggtattaatccatatgtgaatcattttatttttactgtgtttatttgtacttatataaattgcaggtaggccgactataacatttcatgtcttttttgttttttttttaagtgactacggaagagatgtgataaacaatttaaccaaaagtgctatgttggcacgcaaaaacgggccaagatatctacagatggaaaacgggccaagatatctacagatggaaacgtttatatcggatttattccgacatgaatgttatcaagataattattatgtgttagacaaaaaactacaaatgttttatccgactactcatagtaacgaattacttttttatccctcggaagctacgttgccctcaccttggcaggaacctccgttttcctcaccttggccggaacctacgtttccctcacgttggtattggctcttattaaattacacaaattactgagagagtcagaaatcgtgtcacatgttctttattaaatgttactgaactttgtccttacaaatcttcccttttacaatacacagaaaaaaaaataagtacatagaatttctaaccattttgaaaaaacagtttacctatttacaatgttcaattactcaacattaaaaaaaatagcagaagtttacatagaaattacaaggtacacaatatacgtatccctaataaatgtcaaagaaacagtaaatctctcggtagattggatccaacggcctttctgttttaattaaaaaaagagggtggggactgtgaagtaaaactattgacataggaattcttatttaccttcctgagagtaaatatttctaaacacagatggttttaagagcagacaaggagcgttttgtagagtattcagatactcctcttcgttgacggcaagcaaccttttaggtgtaatctgaaaatctaaatagaactttctagccccggctttaaagaaagtttttacgttcttacacaagtaccgtatcctggggcgacctttatgatagccatatattcttaaatctttatccgcggctattaacacggtagccttagtagcggggtttgatttgaaagtggtaacatatgcaaagaaatacaagggtcttccttcacatacgacggcctcgtctcctggtatggaatcaaccgattcaggattgcagagatgtatgactctgtcacctagtctaccaggcattccgttaaaggtccagttacatccgtgcatgttgtccctttgatccataagatcctgaaacgttctactgtttctcaagaaatctcgaagagagttttccatggccacaccgtacggcactgttgattcttcatatataggatcacatctagacagaccctcctccataaactgtttcaaatccgaggcggctaaaaacagctcgtgtgtagagtttgagtaattatgcagaagcacccatctattttcacacaggagaatcaccatgtttttattcagagccgcgggcggttctgcaccgacaactccaaggaccatcatccacccacatggcagtggaaacttgtccttcaaggtaggtatatgttcataccctaatttcttctctgacatgacatataccccgtgtttgggaggccaactgatacttaaataactattgttatttttggacacgtagctctgcagtaattctttgaaataagttaacttactcagaggaccgaaagcggtaacacattgccggaagaaagtcctccggcgtctaccgttcatacacacagtggctggtctagtcactattggaatgaacggaccgtcgttgtcttccatattgactgggtctggaatccatcttctgtatggaatgtcggcaagcaatctcttggcttggcgatactcaggattaaagttttctgaggagtacgtcttggggccgacctttgttacttcttgacagcattggacttcgttgtcgctgtctgtatccgacaatccggttaattccgattcatcatcgtaatattcattcttggttccgctgctcgaacctccagacgcatcctgccgtgtggaatccgcagccgtcatgcacataccgcaagtcacgccttcggacttcatgttatgaatacgcgcacttttccgcggaggttcatttctgacgtctgaacaccctccctcccgtacctggccatcctctggattctcattttgagagtgtatacgtttattttgttgaatggtgcctgcattatccgtgacgtctgtcgcgcagccatttgacatctcttgtgttttatagctcccgtccattttaaccacggatgagttcatgttcatttgttgcctaaatccttgttgtaaattagacacagtgataccttgctgcgaaacttcgattttcatgtcgcagttgctattacagctgaccgaggatgcactggaaagcacatcatcttcttcagaaaaatgtagatcagcaaaggatatatttttttcaaatgaattctgctggcgtaatccctccaactgttctagaaaagttccacaagaaggattgaccgtgtttgacattttttctctcatagctacaaaagacgccagtttgggaaaatttcctattcctccccctcggtcaacaccgtcaaagtttaatttttttattacacctgtgctgggggtaggcttgcatacatttttatctggggtttcattattcccattcattggatgtgcaattgtcgggtttcctccaagcaagaacaactgaggagcacagttcaacgtcgttcttggattgccggtgtttaccacgggaaatgttccatttccttcaaatgcgctatgctgctgaccattggacagggttgataaatctacaccggtggctccgtggacattgccatcattttccggaaaatcatagttttccatttctgtgttagtatttatattgtttaacatatgtgtgttcgtaccagtcatcctcatccaatcttggtgatccggattcaatagagaagatgggacgttagcggtgccaccttgtttatcggaaatggcgtcattaacacaccccacatggccataaacattcgactccttgacatttatggaattattagccatttccgatttatagtattggttccatggactgttattctctatataattacccatgcctcccattgaaacattagcaccccgattatttgataccacccccaccggctggaaagcagagttgacattcgcatctataccagttggtgacgcagtcatgcagtcaatggatgctcctagttgtgtcgcccatgagtttttgatattctgcatgttgcacacgggagtgtaacctgccaaatttacatactcacgtgaattgagaccacccccctgataggaacagtcgctaaacccagatacttgaggttgggtatggaaaatcggttgtgcgttgttgaaaattaaattagttctgctatttggaggattaggggtgttccgtttcagaacccaggattctccgccggatgtagtgaatatccattcatcgcggggtgccgtattaatgtcataagaattagacccgcttccagaagattgattatggacagactgacattctccgggtccttgtgagttagcggtcatgcacggatacatatttagaaagaatttaggattagactgttggacaaagtgttgagcattaacatgagaggaagggtctgtaactgtcatttctcctatcgaatgaccatgtaatttgataattgatgcaggtttgatgggattaatcatattattgctatagccataattttgatcctgtatcggtggggaaatgggttgaaaggtcatctgattgggttgaacattgatttgattgttcatgtcttccggcgaaaggtccgtcaaagtcgaatgcgattggcagttttgatccggtgtgtcattggagaaatacgagtctgacatcatcgctccggtatgacaccccgatgtcgtcggttgaacagacatatcaacgcacaaaggctgcataatatcagttccagctgcagtgttttcgtcacacgtggacgagattacatcgtccgacaaaagttccgtcggatccatattgagaatttgttgccaaaacaaatcgtccggatgtgcagacatctagaggtgacaagccaggggaattaccttattttccgtatacaactataaaaaacttgggaggcgcaaacggtatgttttccataataaatccgagtgatgatttctggactaaggacaaatatatcatgttgactatcaaaggccccatggagtgggaggcagaaatccctggaatatctacggattttttctgtaaattctctaacgtgtccgtgccacatttcagggatatgcactcaccgggagcgcccgatattaaatggataactgcatgtaccaaaatgatcgatgtcatactcaattactggaataataaaactgccgtccccacccctgcaaagtggtacgctcaagcggagaataaagctggcagaccctccctaatattattgatagctttagatggaattcccagcgcaacgataggaaaacacacaacggaaatcaggggcgtattaattaaagatttcttcgacgggaacgcccctaaaatagatgattggtgcacgtatgccaaaacaaagaagaatggtggcggaacccaggtcttcagtctaagttacatcccctttgcccttcttcaaattattagaccacagttccaatgggcgtggacaaatattaacgaactgggagacgtatgcgatgagatacatcgaaaacacatcatatcccattttaataaaaaacctaatgtcaaacttatgctgtttccaaaggatgggattaacgggatatctttaaaatctaaatttctgggaaccatcgaatggctgtctgatctcggaatagtcacggaagacgcgtggatacgaagagacattagatcatacatgcaattgttgacgctaacacacggggacgtgctaatccatagggctctatctatagctaaaaaaagaataagagcaactaggaaagctatcgattttatagcgcacatagacactgactttcagatttatgaaaacccggtttaccagctgttctgtctgcagtcttttgaccctatattagcaggaaccatattatatcagtggctaagccacagaggaggaaaaaaaaacaccgttagttttatcggtccacccggatgtggaaaatcgatgttaacgggagccattcttgaaaacatcccgttacatggaatattacatggatctctgaatacaaaaaatttaagagcttacggacaggttttagtcttgtggtggaaagacataagtatcaactttgacaattttaatattataaaatccctccttggaggtcaaaaaataatatttccgattaatgaaaacgaccatgtacagataggaccgtgtcccatcatagccacatcttgcgttgatatacgctcgatggtacattccaatctccacaaaataaatctatcacagagggtatataattttacatttgataaagtcatccctcgcaattttcctgtaattcagaaagacgacataaatcaatttctgttttgggccaggaaccgttctataaattgttttattgactacacggttccgaaaattttataactatatatttaacaacatcttaaaagaccacttttaaaataccgacaagaaaataaaaaaaagacatcacattataagacactgataactcaccctgtaccgctgcgtccgagttagcagaagaacagctaatggcgcataacggaaaaatgcctctcctataaatactgaagttaataggtgtggtaggaaatgatgagtaatacatcattaaaatattctactttctggcttctgattcgttattcgtaagtgggtacaatgaaaaaaaaatcaacattcccttaatgtatgcatcatcaagggtgctgattgggtagagatataacgatatataaaaaactgcatggtgagcaaaataatttgtttttccataaagttaaaggtcagtgggtgttgtggttagggtctttcctacccaagcgggttagaaccttaaaaattgctaacggggcaaccgcagttcctgtttttcttcataaagataaagatcagtgggtaccgcggttggggtctttcctgcacaggcgaatgaaaactctaaaagctgctaacgcggcaaccgcaatttctgtttttctcggaaaattaaaggtcagtgggtaccgcggttggggtctttcctgcccaggcgaatgagaactctaaaatctgctaacggggcaaccgcagttcctgtttttcttcataaagataaagatcagtgggtaccgcggttggggtctttcctgcccaggcgaacgagaactctaaaatctgctaacggggcaaccgcagttgctgtttttctcggaaaaataaaggtcagtgggtaccgcggtttgggggtctttcctgcccaggcgaatgagaactctaaaatctgctaacggggcaaccgcagttcctgtttttcttcataaagataaagatcagtgggtaccgcggttggggtctttcctgcccaggcgaacgagaactctaaaatctgctaacggggcaaccgcagtttctgtttttctcggaaaattaaaagtcagtgggtaccgcggttggggtctttcctgcacaggcgaatgaaaactctaaaagctgctaacgcggcaaccgcaatttctgtttttctcggaaaattaaaggtcagtgggtaccgcggttggggtctttcctgcccaggcgaatgagaactctaaaatctgctaacggggcaaccgcagttcctgtttttcttcataaagataaagatcagtgggtaccgcggttggggtctttcctgcccaggcgaacgagaactctaaaatctgctaacggggcaaccgcagttgctgtttttctcggaaaaataaaggtcagtgggtaccgcggtttgggggtctttcctgcccaggcgaatgagaactctaaaatctgctaacggggcaaccgcagttcctgtttttcttcataaagataaagatcagtgggtaccgcggttggggtctttcctgcccaggcgaacgagaactctaaaatctgctaacggggcaaccgcagtttctgtttttctcggaaaattaaaagtcagtgggtaccgcggttggggtctttcctgcacaggcgaatgaaaactctaaaagctgctaacgcggcaaccgcaatttctgtttttctcggaaaattaaaggtcagtgggtaccgcggttggggtctttcctgcccaggcgaatgagaactctaaaatctgctaacggggcaaccgcagttcctgtttttcttcataaagataaagatcagtgggtaccgcggttggggtctttcctgcccaggcgaacgagaactctaaaatctgctaacggggcaaccgcagttgctgtttttctcggaaaaataaaggtcagtgggtaccgcggtttgggggtctttcctgcccaggcgaacgagaactctaaaatctgctaacggggcaaccgcagttcctgtttttcttcataaagataaagatcagtgggtaccgcggttggggtctttcctgcccaggcgaacgagaactctaaaatctgctaacggggcaaccgcagtttctgtttttctcggaaaattaaaagtcagtgggtaccgcggttggggtctttcctgcacaggcgaatgaaaactctaaaagctgctaacgcgacaaccgcagttcctgtttttcttcataaagataaagatcagtgggtaccgcggttggggtctttcctgcccaggcgaacgagaactctaaaatctgctaacggggcaaccgcagttgctgtttttctcggaaaaataaaggtcagtgggtaccgcggtttgggggtctttcctgcccaggcgaacgagaactctaaaatctgctaacggggcaaccgcagttcctgtttttcttcataaagataaagatcagtgggtaccgcggttggggtctttcctgcccaggcgaacgagaactctaaaatctgctaacggggcaaccgcagtttctgtttttctcggaaaattaaaagtcagtgggtaccgcggtttggggtctttcctgcacaggcgaacgaaaactctaaaagctgctaacgcggcaaccgcagtttctgtttttctcggaaaactaaaagtcagtgggtaccgcggtttggggtctttcctgcacaggcgaacgagaactctaaaagctgctaacgcggcaaccgcagttcctgtttttcttcataaagataaagatcagtgggtaccgcggttggggtctttcctgcacaggcgaacgagaactctaaaagctgctaacgcggcaaccgcagttcctgtttttctcggaaaaataaaggtcagtgggtatcgcggtttgggggtctttcctgcacaggcgaacgagaactctaaaagctgctaacgcggcaaccgcagtttctgtttttctcggaaaattaaaagtcagtgggtaccgcggtttgggggtctttcctgcacaggcgaacgagaactctaaaagctgctaacgcggcaaccgcagtttctgtttttctcggaaaattaaaagtcagtgggtaccgcggtttggggtctttcctgcacaggcgaacgaaaactctaaaagctgctaacgcggcaaccgcagtttctgtttttctcggaaaactaaaagtcagtgggtaccgcggtttggggtctttcctgcacaggcgaacgagaactctaaaagctgctaacgcggcaaccgcagttcctgtttttcttcataaagataaagatcagtgggtaccgcggttggggtctttcctgcacaggcgaacgagaactctaaaagctgctaacgcggcaaccgcagtttctgtttttctcggaaaattaaaggtcagtgggtaccgcggttgaggtgtttcctacccaggcgaacgagaactctaacatctgctaacgcggcaaccgcagttcctgttcttctcagaaaaataaaggtcagtgggtaccgcggttgaggtgtttcctgcccaggcgaacgagaactctaacatctcgtaacgcggcaaccgcagttcctgtttttctcggaaaatatttcctgcccaggcaaacgagaactctaaaatctcgtaacgcggcaaccgcagttcctgtttttctcggaaaattaaaggtcagtgggtatcgcggttggggtctttcctgcccaagctaacaagaaccctaaaatttgctaacggggcaaccgcagttcctgtttttctcataaaattaaaggttagtggggaccgcgattgcaacattttcctctgactgagtcatttatttattgagaaacgctaacaccaaaaccacatgtcttatgatgtgtaacagatgttcttagaaaaaacatgacaatttatcagtaaaatgttgtttattataaaaaacctcaaaaaatccagaccacaaattcctgtttttgtaaaatataacaaaaccctaaatttttgcaagcattaactaatttcaattccatatttgtctaaaaggggtgtatttctgcacttgcggtttaacgttatgcagcgattggttccttcatcttcgtcattttcctgtacatcacacccgctacagaattgtatataagcagaagttacagccagttcagtgccactattctcaagaagtggctccggagaacattctcatcacagacattctttcttatatcgttgcagtctggtaagtcaattttgtaacgattaatatttaagattgctacaaaaattcttttaaattgcatttaaaatttgtaaaacaatttaatgatattttcatgcacatgattgtaatttgttaatcacaaaataatttataatgttcacatttaatcttacagatttgtcacatcgattgcatcccatcaattattacattgctggattttcttcccacccagaagattgattgcgcccaaaaccaccacttggaatcatctccaaagaaacctccaccttgaatcactcttaaaaggtaagaaattatattgtacatacttcaacattcgaatataggcagaacagtcaggtattttcccccaatataagctctccatacatctctgcaaagaaaaatacagacattacacattcatttcacctttcggaaaaatagcctcatttaaagactgtaaagtctctactgaagaagcagaagattgcatttcgctcttctcttcttccgtggtccgggaacatataatgcatgccattattatgcaaaccaataggataattgataatgttgtagttaaagcctgaatccaaactggaggttccccttcattttttttcattgattctttgttttccatggcttggctcgttacggaatctaaaaacaaaccatccgtgatattttttttttcattcttaaggaatgtatgcaaatatataatcaatacattaaaataaaaaagacatatccttcactaaccaggagtagtggtttcagtgcagttggtagtaggtgtgcttacatgcttcagcgccgcagtcacaccttcggaatcatcattggaatatctttggcccgatataatttccagtattagcaaaaatattgttgccattagaaatatcaatagtagacatgccagtatctttagattagtttttccagttccagtagatgattttttccccattatggtcagtgttacagatgtgcaagcagagaatctctgcaaagaaagaggtggtggtaatgtccttatatagtattatatgtgctgacgggagatattttttcattggctatcagcacagtaggcggtgtctcaatttgcatcttaatatacaatggagccagcaaaaccctctggaaacaacatgggatccaatgatgaacgtatgcaagagtaagtatgattagtcattattagatctatcttatttaagattatttgggaatttttctaagtacttaaaaaatatttatacttacagctaccgtcccgatccaatgatggaagaatctatcaaagaaatattggaagagagtctcatgtgtgatacatccttcgatgacctgattattccaggccttgaaagctttggtcttattataccagagtcttccaacaacatagagtccaataatgtagaagaaggatcagatggagagttgaaaactttagctggtaagtacatgaattatattatatgtcccaagatagaaaacaagaaaaaacatagttttaaacatgtgacatataacatactcagaatatcttcttttacatcctagctcagtccgctgggaattgcatccaaagtattggtgcatcagtgaaggctgccatgaaacaggaacagtctgacatggaagacaaattaattaagtgcgctggcttattaacgcagcaacaatccatgttcataggactaggattagaacaattatcacagttgataaacattaatttattaagtagtgcttcaactaaatatgttgaatcttattcaaaaatgttgcatggaaaagagttggatttttttaattggtgcgaacctagattcattgtttttgcatgtgataaattcgatgggttagtgaaaaaggtggcatcagaatccagaaacttgctcctggatttgagagctaatatgaacaatgacattattaaggccgtcaaagacattttttctaaagctactgtgacattagattgtcagaaacttaaccagggcgccaccatgttgatgatgatggcacacaacaaagagatgtccaatcctgacatctccagtaaggacttttgtgaaaaaataaatacacttaaacagacattactggaaggtaaaaatgagatagtagaaacaaatgctaaaaatatgcaaattttacagacatttgctataaagcagatgaatcaaatcttcatggatggttgtgataaagcattccttaaacttaatgtgaattgtaaaaatttaattactgccgccaaaaatcttgccaatactattctccagagtattgttatatgcagcaatgaattttcatggcaacacctcaaacttctgagacggggatttaaagttaccatgctgaatatgattacccaggcatgtgaatgcttagaatcagattatgatgatactggtttaattaaacctttaactccccttcaaataatggacggctacattaatatgaataaaaatagacagtcttccatctgtgatggaaacacagacccatcagactcaatgatattagacttagctgattttgatgaccatggaagatattcagaggaatcttctatcgaatctatccatgaagatgatgacaataaaatgtatccatgcactccttctccagaagtgccagggaaatccaaatatgtaggaacattcactgaaaacagcagacagtcaggggacgaacaaacaaaccctaactgtgtaggtacagcctcagtgacagatctgggcggccctgataacttgaactccatcagcggcctccagagttgtaaaaacatgttgctagaaagactacttgacactcaatgcgattcagtagttgaagggacagaacaagatggttcctatggcaacactttaatatcagaaatgatgatgtttggttatgaaactgatcactcggcaccctatgagagtgaaagcgataacaatgatgaaattgattacattgcaaactctgattcagctgcgagaactaataacattcatatgaatagcactgatgagaatacaccatttagcaattctatatgttcaccaccagaggtcaccccttctaagaaaaatgtcaaacctaagtctatgactccgggaagcaaacctaaaaagagggtagctaaaaggaaacatgtttcaagtaaatcacccaaaaataaaaagattaagacagatcagttacctaaggctgcagacgtaattgttataagttcagagagtgaagatgaagaggatggtgacaatattattggtaactcaatcttaataaaagctattaaatcagaatcagattctgaatcgagcagcgagtcaaatgactgtacatctgaacataaacagttacatttgagtgattatgatgaagttaccaataatggtcattgtccaagttatggttttccaactccagtgtttaccatcccaataaggtcaatgcagggtaccggtggtatcaaatccaaatttattcccaaaaaaaattggatttggtatatgaagaaaactcaccaagtagacaattgtcctattcacaattctgaaaatgtggatgcaaaagatgacagtgatgggacagaagccaaacactgctttatgaatcactttgtccccatcaaaacggatgatgaagactatgataagaacaatgtctcatatatttataataaaatacagaatagcaaaatagactcgggagacataataccaactaagaaacttatcatagatatggtgatggataattttatggatctaaatgatatcattaaacagggcataaccaaacattgccaggatctttgcaataaatataatgttgtcacccctactacatgtgaggacgatttaaatatgacaaattcccaaacttttgcaacaaccgcaactcaagtgtttgacccaccggtaacaggaaataattcctccatactaaatattatcaatgacacaacaagtcaaaatgatgaaaacagatgcactgaaggtacaagtaattctaatgaaaaatgtaccaatataagtgattgcaacagtgatggtacagaggcctttaaattagatggctacccttctgattatgatcctttcgtagaaaatgctcaaatctattagctagatgaaacctagatgtaaattgattagcaatcattagcatacagatgtgtattatgtaaatatgcttatactgttgtaaaatatagactttccccatattgtgtaactctttttgttgctatagattagaaattacataagcaaatgtaactttttgtattatgtaatacatcaacaaacacgtgattcctcaaatgaatttattttcaatatcaccttacaaataataaaaagtaatatagacattgctttctctttttaattccaagacatgtacatcaactgacttataagtcatcatataatatttccataagttaattccagctttcttagagacgtgatactataaacaattgtattcttgaaaaaccttatacagatgtcaagtattcagatttttactttcacttccccaaactaaaccagttgattaagactaatgcccccgagacatcttaattctataaatcatagtactgttaaaaaatatattacattagctatagctagatcataacactctacaaaatatttttctttcaggtatatttaatctgtttttgcttaacattcacataatagctaccatttatgaaaaacattttcaaccattagactttgaatgtcacaccaaacacttgaaagtatatatctaaaataccaaatccattttttattgcaacatcttattaactggaatcactttgaaggtaagatgctacacatgattcccaattttggaaacacagattgaaaattaccatatttatatccccccccccatatctatctctctatcctctatctctctatttgtttccctctattatacacatacacatacacatacacatacacatacacatacacatacacatacacatacacatacacatacacatacacatacacatacacatacacatacacatacacatacacatacacatacacatacacatacacatacacatacacatacacatacacatacacatacatatacatatacacatacacatacatatacacatacacatacacatacacatacacatacacatacacagagacatacacagagacatacacatacacatacacatacacatacacatacacatacacatacacatacacagagacatacacaagagacatacacatacacatacacatacacagagacatacacagagacatacacagagacatacacatacacatacacatacacagagacatacacagagacatacacagagacatacacatacacagagacatacacatacacatacacatacacatacacatacacatacacatacacatacacatacacatacacatacacagagacatacacatacacagagacatacacatacacagagacatacacatacacagagacatacacatacacagagacatacacatacacagagacatacacatacacagagacatacacatacacagagacatacacatacacagagacatacacatacacagagacatacacatacacatacacagagacatgcacatacacagagacatgcacatacacagagacatgcacatacacagagacatgcacatacacagagacatgcacatacacagagacatgcacatacacagagacatgcacatacacagagacatgcacatacacagacacacgcacatacacagacacgcgcacagacacgcgcacagacacagacacgcgcacagacacagacacgcgcacagacacagacacgcgcacagacacagacacgcgcacagacacgtgcacagacagacacgcgcacagacacagacacgcgcacagacacgcgcacagacacgtgcacagacacagacacgcgcacagacacacgcacagacacagacacacgcacagacacacgcacagacacagacacacgcacagatacgtgcacagacacacgcacagacacacacacagacacacgcacagacacacgcacagacacgtgcacagacacgtgcacagacacagagacatacatagagacatacacaaaaagcacaatagatcaaattattaggtttaaagtactttaaaaatgtctatttaccactattaatctttcacctgaacaacggagggtgctatcacatcagaaacatattcaaactactatacttaaaatgctcaatatcatataatttacctcaacagcagagggcgctatcacattagaaacataatgaaactagtctactataaactttaaattatgttatctccataatacataataaataattgtattctaattatcaaattatatccatccccgtggtagcatcagtatttatttgattatgcatattaaccctttgatagtcacaaacttcactcaattcaatttcaattattcgttaatatatccacgggtttcttgcacacaaccaacacaattagacaagtagataattgataaataccatatattaaaaacatgaatattatacatacgcccgccccccgactaataaatctcacttttacccaatatactggatttactgcatgtcaataatgaatacatcaatcatttaaatttttaatattaaaacaattttattataatataatctaatgcaaatatttaaaaataaattaatagaccatccaattcaattgtcattaacttcaccgggtttcatatataacttatgtcattgtccatcctagttttaaatgaaattaatatatgacacctaatatactattgttatataaataatcccccccattgttagtaattcgatttagtgaatttttactacaaactataacgtcttcatttgcacaccacgcacaatcggtatgaacatcatcctctgcacggactgtatcataatgaaaatgattatccgtaatttattaaatacattaagcaaatactgtctattaagcttcaattttataaacatgttttccagaacaaaaatgcaaacaaggaaatgataacgacgtcattcaaagcgccatgaaattatccggactatactgtgatgcggacatcacacacacacaaccgttgagtgataatacgcatcaagatcctatatattctcaagaatccagaatattttcaaaaactatccaggatccactagtagctcagacccacagacaatgcacatcctctgcttccaatctacaatcaaacgaaagcggttcgacccaggtgcgctttgcttcggaactaccgaatcaactcctacagcccatgtacacgtcacataaccaaaatgcaaatctacagaacaatttcacctcgttgccgtatcaaccttatcatgatccatacagagatatagagagttcctacagagaatctagaaataccaatagaggatatgactataactttagacatcatccgtataggcccagaggaggaaatggaaaatataattactacaatccaaactcaaagtatcaacagccatacaaaagatgttttaccagaacttataacagacgcggaagaggccacagatcatacgattgctcagacagatccgcggatttaccatatgaacattacacgtatccaaactacgaacaacagaatccagacccccgtatgaataactataaagattttacacaactaacaaacaagttcaattttgaatcctatgactatagcatggcattctcaacagactccacacacgtacaatccgacaattacaatcatccaacaaaagcacagacaataccagaaactacaaaaactaaaaaacatgaggctactaaggataacgaaacatccacagaaaatcaagttttaacgcctgacgtaatcagtttatcatacagacctagttcctacaaaatggatattattaaaaaaatatatgacactgacgttattccgttaccgaaggaagccttaacagccaatggctcaaatcgtgacgtggatattcagaagtacaaaaaagcacatatccgttgtagatcagtccagaagaaaaaagaacgcagttctcaaacaaacaaacatgatgaaaaccatgcctcatcacgttctgatcttaaggagagaaaatctaatgagaatgaagataaagccgttactaaagctagagatttttcaaaattaaaccccctattatctcctcttccgttgacacctgaacccgccatagactttgcggaccatacagataaattctattcgacaccagaattcaaccaaatacaacaaaatctacaccgatcaaaaacttctctacaagacacagttcccatatcaaaacatactccaagagccccgaccaaagataattcttacaaaaaacatcatgactccaaagacaattatcctaaaatgaaacattctcctggacgtacaacatctaaaaaaaatactacaaactccaacggacaccaaaactttaaggaagtatccgttaagaatgtttcagggaaagccacatctacatcaccaaaatcaaaaacacaccattattccagtagctctgatgaagaaggtcaatacaaatctccggtaaaaactattatccaatcaccttctccatattgcaagttaaaaaatccttcaattatggacaagaacagtgctaaaaaccacactgcaagcgccgacaaaaatttaacagacaattcacctattcggagtaatttaaatcctactgcttttaacaaatccaacagtaacaaaagcatcacggatagcacttctaacagtgatgagtgtactgacaggaaacctaactgcaattccaccaaaaatgaatctaaagatcctaaccgaacttgtggcaaaaactctgataaacatctgagtaaaagttgcaccatggcttctaaaagggctcccagcagagcctcaagcagagcctccagcagggattctagcagggatcaagcagagcctccagcagagcctccagcagggattctagcagagcctccagcagagcctccagcagggattctagcagagcctccagtagagcctccagcagggcctcaagcaaagcctccagcagagcctccagcagagcctccagcagagcctccagcagggattctagcagggcctcaagcaaagcctccagcagagcctccagcagggattctagcagagcctccagcagggattctagcagggattctagcagggcctccagcagagcctccagcagggattctagcagggcctcaagtaaagcctcaagaaaagcctccagcagagcctccagcagggcttccagcagggcctcaagcaaagcctccggtaaagcctcaagcgaagcctccagcagagcctccagtaggaattctagcagggcctcaagcagagcctcaagcagagcctccagcagggattctagcagagcctccagcagagcctccagtagggattctagcagggcctcaagtaaagcctcaagaaaagcctccagcagagcctccagcagggcttccagcagggagctgaggcagatttattgcgattctaataaaagacaaacgcctccacatgacacctcaattaatacaaaatttgaaatatcagaaataaaatttcgatgtggagaagatctaaatttctacaaaaatactgcagctcgactccagtgctttaatcacaatgatcaattttacaacccccgattcagacctcatataagaaccaacagaaaaaaatcagaatccaccaatgacaccgattcagaaagttctatgtctagatgcaaatctcactgtcgaaattcaccagattcactgaccgttgtaagaagaaaaaaacacaaatctggatcatcaagcatctcttccagtattgaagaaaattgcagatctaattcacatatagtaaccggaaaagagaagtttacaccattttactatcagtcttccagaactagatcatcatcatcatcatcatcatcatcagcttctttatcatgttccaaatccacattaaaaacatgccgcaaaactcaatataaagacaataaacaaataaaatctaaatcagattcaaaacacaaaactacaaacatgtcttcagattacgaatcgaatagacatgcagatgtgtttaaaaactccccggaagcaggtgaaaaatttcccctacacaattctagtccatttaacacacatgaacaatccaatcattccgaaaacgccattgatgaagaacaaaaaaaggcacctaatatcacgacttctcacctacagggaaaacaaaatgtcagattacacaacacaaaaaaatgcaaaaaaaaacgcccccgcgatgatgattcagattccagcataaaaaatttctgcaagaaaagaatatccggagcgcagaaaacagagtctgaagtaagtgaacctgacgatttgtgttatagagattatgttagactaaaagaaagaaaagtatcagaaaaatttaaaattcaccgcgggagggtggctacaaaagattttcaaaaactatttagaaatactatgagagcatttgaatacaaacagatccccaaaaaaccttgcaatgaaaaaaatctaaaagaagctgtatacgacatctgctgtaatgggctctctaacaacgcagccatcattatgtactttacaagatcaaaaaaagtagctcaaatcataaagataatgcaaaaagaattaatgattcgacccaacatcactgtttcagaggcatttaaaatgaatcatgcaccgcctaagtattatgacaaagatgaaattaaacgatttatccaactacaaaaacaaggaccgcaagaattatgggataaatttgaaaacaacacaacacatgatctatttacgagacattcggacgtaaagactatgataatttacgccgctacgcccatcgactttgtaggagctgttaaaacatgcaataagtatgccaaagataaccctaaagaaattgtccttcgggtgtgttcaatcatcgacggtgacaatcctatctccatctataatcctatcagcaaagagtttaaatcgaaatttagtacactttcaaaatgttaactcccaacttttttttaaaaaaaaataaaacagtataacggaaatccttgagtttttttattttaagcgtgacttatatatatatcagaaaccgctatttggcatagaaactgctatttgacacaagcgtacactatgagttctctgatgcttcggttattgccgcttctatatatcataagtgcacattttgtactccacccggagacgagtccttctttaatatacgaaatagggtcaattgtcactttccattgtcgcctcgaaacaaccacaaacatccgaagcgtctcgtggtacaataaaaaccgacttatatcgaatcatgaggtacaaaacatggacaacttatcgttcactgacgatggctacgtccttatacacgaactaaataagatcaacaatctcgccgtggacagtaaattatatttccacataaaacacaatagaactacatctctgttgaaaattaaagccaaatcagcatatgacgcgacatgtttaacctgtacattcacagtagataacgagaaaacgtctgcgactagttgcttaaaactctttatgaaacccatcgtcgttttgtactttcgttacttagacaattttttagacgttacgtgtaccgtgacgtcttatccaaaaccaaatgtggttattaaatttcttggagaagtatataagagagacataccaatagttagacagaatgagaacggatcgtcaaccgttagtgtgaactttactttcaaaagacgaacgaagctggaatttgtcgggaaaaccgtctcatgtctagcgtcgagttggtttaccaaccaaaaggctagcgctcttgtaacttccggcgaacacactgtgcagaatcacgacgaatacagtaaagaaggggtaaaaagttcaaattctgacgaaaccgtatttacctggaccgtaccattaattctgatattgatatcagttatagtgctactgatttcggtgtgtatcgttgcatttaaaagttaaaatttatatagcttaagttcagaagagatgaaagacagaggaaataaaaacacctctaaaacaagacagaccgtcaaatctcgccgaactagaaaaacaacgaaacagttcgtagaacggaaaaaaaatctatccgctaaaacgactatacgaaataatcgattacaaaacaatctatctccgcaaaccaccccaaccgaaaaacccgtcgattatgcgactgcaagagtctttccccagcacaccccatacgatataaaatttaataaggaaaaatatcgaaataacgagatctacgcctattccaaactacggaaaatctcaaacgccgtgtttcgccaagaaaaagaaattaatcgtcttactgtatttacggacaaacctctcgccgacctgtcattcaaaatgcctgtaaatacatcgacaacggagaaaaaggaaattgtcaggtctacggaatgccaaaggcaagatcggaatacagtcaacgctttcaaaatttttcaatcttacgaaacatctccaccttactccccgtgctcacctaaaaattttatgtcagaaatttacagattattccgctgctacaacgcttcaattgtgcaaatacaggtttattcccgaaataagatcttaataaacgccatgcaagaaaaattgatgtccatcggcaacatggttattaacgtgggcgagcagataatttctgaatcggttcaccatgaaccggtagtcgctattgcaatcaatcagtttttcagagggaccgtcccacaaacggacgcactccgaaaaaacgctgtaactcctataccggtaaacgcctcaaaaaaaaagcttgtcggcatttgctctctcatgataaacgcgccaacggaaaaggatttattatgcgccgctcacgtttgtatcaattttgcgatctgctatcccaacgagattactttgaatatcgcaaagctaacacaaccgatgctccttcaagaacacatcaccatatacaactctttcaataaatatatttattgggatgattatggcaaactattaaactgactaaataaacttttttggctcgaatctaaattggtctctttgcgtcttctatattgttcgtcgtaacgaaaaagaaaaccagtattaatgtcttcgaatactttcatgattctttgtctaatttcgacaatcctaattcaagacttgtcggcgatgcatctgccatatcacacatcgagccctcgtccaaatcagacgggtaagcagcagaacaactttttagctttttaatcatgattgcatcaaaaagttttctaaaaggctctgttttcccaggtacggcagcggaccaatccatgcaacacaacaaacatcctaacaagacagaagacgacatacgtgatttttcggaaaacagctccgcatcgggggaactacatataaatccgatagccataccaatatatgccgtataaaaaaccaataaaaagccgaatggacatttcgacaagtctttttccctactatatataagatgttgttcccgtcgtgttaacttttccaaataaaaaaataaccatggaacttttactatttgtaatgtcactcatattactaaccttctcaaaagcaatacctcttttcaaccataattctttctattttgaaaaacttgacgactgtatcgcagctgtaataaactgcacgaaatccgaagtgcctctattactagaaccaatctaccagcctccggcatataatgaagacgttatgtcaatactgctacaacccccgacaaaaaaaaagccttttagccgtataatggtaaccgatgaatttctcagcgacttcttactcctacaggataacccagaacaactacgcacattgtttgcgctaataagggacccagaatctcgggacaactggctaaactttttcaatggcttccagacatgttcaccttccgtcggaataacaacctgcatcagagataactgtagaaaatattcgcccgaaaaaattacgtacgtcaataacttttttgttgataacattgcgggtctcgagtttaacatttcagaaaacacagacagtttttacagcaacattggttttttattatacttggagaatcctgctaaaggcgtcacaaaaattattaggttcccttttaactctttgactctttttgatacgattttgaattgtttaaagtatttccacttgaaaaccggagtagagctcgacctgctaaaacatatggaaacctacaattctaaactacctttccgaagttcccgccctacaattctgattagaaacacataattggctatgacatcacgtcccattcacataaaatcctcctagggaatttaatccactgcatttcattccccgaccatggccctactacagtggatgttagatcacgttcaggatgaagaaaaaaactgtgaaaacctttcaatagatgatcagcattcactcttcggcataaacagagactggttgagtttcctgcaactctccaagttagaaattacacaccttaaacatgtatataaattggtggacaacgatagggctcatctaatggtccacccctcttcggataacgtccacgcttggagttttttatgcaaacccgacaatgtaaaagttgtgattttgggacaagatccgtatcccgacggcagaggttgcggcttggccttcggtacagtgaaagagtgctcgattccagaatctctaaagaatatatttaaagaactggaaagaagcgtgccgaatttttccccccctgacaacggctgtttaaactcctggtgtagtgaaggagtcctattgctaaactcgatattcactgtagttcatggattaccaatgtctcacgaggcatttggctggcaaacactgagctataagattatcagcaaactatcggtagaaatggactctctcgttttcttattgtggggaaaccatgcccggaaactctcttatctaatagacgcacggaaacatctcgtcttagaaagtgcacatccatcgcccaaagtgaagtctgcaaggatgccatttattggttgcaatcatttcgtgcgagcaaatttatttcttacggagcacgggaaagacccaatcaattggaacattctgaacgaataaaacctattcagtttacctaataattacaatacaacaataaaatttacagtgtttccaatattgtggttgccagtaaatcttcattaaaactcccctcattttcaaagttttcggcttcgctgctatcgtctataacaattgtagtttgtgtccttgaattatttatattggaatttcgtctcctgggagctctccctcggccacgtcctcgtgctctgcctcggttttgtcccgaaataacacgctgttgctcgatcgcaccatctgttgatccgacgattgtcctggtccgttgtcgaagtcttcttgggctccgcgccgtttcaaatagtcgcacatcgataaacggtttaatctcacacacgggtaccggcctgacacaatcagaaaacactatctgtttctttggctcgatatgttttgttttacttaaacatttacttggaccagtaacatcagcacattcattttttattaaattatcctttacattatccaaacactctttcaatttcaaaagcgatctttctacaatgtcgccgctgcttgcaacaagtttggccctaagctgttctaaagacttattaagccgaaaattcccataattatcttcattggatagaccttctcggttcgtcccctaaaataaaaagatcagctttagatacgcacaacaaagaccccgaagacctaggttttggcgaacccgaaactccacccacctgcgcataagcgcgcttgtctaattcatcatgttgttgatcttcgtgattatcaatagaaatacagggcggtaacgcaccctcaaccgctccatttacgagtgtcgtagaagttagtgttatgccatcctcgtgactttgttcttccaaattacgtttcatgtcatggtacttctgtctcttctccttaggaagttctgaaattgcaacaaaacagatactatttaaaaaaaagtccacgaccgtgacacacgaaaaataaaaatttacaacaactatacatttatatttaccatccgattcctcctttttgtccggttgcttgtcttcgtcgtttcgttttctttcttcttgttttcgtctgtcatcatctttttttttgtccgtgtcctccacttttcttttttctttttgcttccccgagcgttttctgtgttcatcatcgtgtttttttctatctaaagctcgacattctttttcaaacttttctatacatttcggatcgcccagatttcgtatatcatgctctttgaaaactttagtgagagtaacaaacgttatttgaagtttgttgttttcttgggaaacagtcaaaatcctatctctaccctcagtattctgagaaatcgacgtgatcgatttcgaacacagtaaaaaaccccgagcattgtacgttttatattttccatcatctatcccaatatccaccgttagagaacccattgaatttgtatcggatgtccaacaaatcattgatatccatccaccacaaaatgtttcacacgttccagagtcacctaagaactcaattaaacagccactgccgaaatgaagccttttcagctgaatagactcggtaacaatctgttgataaacttccataacatcgtcaaatgacccatatgcacgttcttcagcatacatcttatctgtgtaaaaaataaaataaacatgctcgacatcatgaaaatacacatagcaaatcgtaacattacagaaatccaaaaacgactaaaattgatacatgcacttttaccagaatattcccatataaatcccagaaagatgagtcatttgccgctcatctaacacaaatgagctagcgaacacagttaccaacgtccttttatgcgcacgaatcacacttccgggctcaagcgtttgcgatccaaaaaccacagcacgcaactaaaacgatttatttttcccatgaaacgacatatctaagtcggacaacaaacacgatataaaaatatattaaatcgatatgtgacccgatatctaaaaataccgttcgacttttttccgtatcgacttttttattaacggttaaccacattctcatccaaaccgaaaacctttacgtattgcgtcagcgacaagggcgtggactttgtcgtaaaatgcatataaaaaggctcgtcgcctgtcagaagtattagggatcaaactatgtaagtctcatacacggcaaaacagcgaatattaaaccgcgaactacaaatcacgtgaagcttgatgcagactcttatacagattgaacgtatacactttgatacattatggaacataaatactaaaatgtagttagatcgaaatgaaaactttataggactattaaaattgcaaattcatgcttatataatcgtgaacaaattcggtgtttttaatgttccgtgaaaaagtttacagcgcattcgacacatggaatttacgtctactctaacgttgacctgttgtaacttcaaggtaagatttaacctattttgcatctacgcacttccaagagctcaatacaattttgtatatatcaaaaaatccctttagtctttttaatagaaaatcgtttatcaactaagatgtaagttagtttccagcgtatagttatcgagggacacatcattaaaatctgcgttgcataaaaacttggactgctaaaaattacacttgcttaaagaaatagtcatctagttttttcggaaaaaaccctcgttcacaccatgctagcctgaatggaaagtcgtaggtcactggttctttctataacagatgaatatgcttgcttattttctctattgtcgtcaattgcttctggctgtggttctcatagaatttcccccccgtctgtgtggaaacacccttcgattttactcgtatcacctacctctctctacttgtcatatctccgattcattttatttaacatcaagaactaccagtaacttgttgttttgccatcttctatattgtcatcagaaaagtcatcagaaaagtcatcagaaaaaaactacaggatatctaaaattattttcgaataccatcgaaaacatcaaaaacatgttcaattcatcaccatatactttgagtacaactgcataacattgttacaagtttcaatatatgattttcggattacgacttggacaccggtaacctcgctcacaatatttcacatattgtgttgtaagatacgaacctcatgagtgtttaacgctcatgaagacggcaaaggcggctgctcttgtccttttttactagttttcacacgttatatctaaagtcagagattattcacggctaatatgatccgatcgatacccggcgaatggataaacgtgtctgaaacctagaaaccgttacgctctcgaaagaattcaaaaaccgccaagagatagaccttgatctatgtaataacgtgaagtgggcctcgttgtttcataaatcaaagacgattgctttagtagtggggggttgggcacaaaacagttgattatttagttcacattataaggacctaaaaattaagtatagttgataagttaagtttagtctataagtatagttaagtatagttattaagtaagttaagcatctaatcattttgtgattccaatcattactcctggatttttgtttatctggattcatacagaaacattggatcatatgcaggcttttgtaaataacctattactaaaaacaactctaggatttaatggacggatctagcatatttttttcgtcatcttattcttaccccgatacctaaaataacttcagtagtgcaaaaaataaaggagcttcgattgatacttaggacaccatccaagccaccacctgagttaacatcaaagtaactattaacgagttcgcggctgcttaataggctaaattgtgcatttttgaggtttccccccggagtacatacgtgtactccgggggagactttcatttgttttttgcagatgtcatctcagaccacacccctgcagctgtagtcaattttgcgacgaaaccgaaatcataaccgtaagttatttctcaccagttcctcataaagtttcatacccttctctgtttggagacatactgtactaaatccccgtggtacctttgttttgcagagaaaaacggaccgacgggaatgagctcattcgaccgtatgggattttaacaattacacgcacaattcatctgatgttttagttttttatatactcatagaaaacctccctaaaatattaacatggtattttcgttctttaacgcttttacaatatgcggagcaataaagttatcattctcataattcagtcttaaaggattaacattcattattaaattattcgggtcggttactcgtgacatcccaacataaatagaactcaattttaaatttttcggatcactcccgaaatctattgcgaccttttgtatggaaagcccttgacttttcgtgatggtcatagaaactttagaaacagtggcgtaatccaccgttgtacatagatgaaaactctgaccatttacgacgtcgataaatttcgacacgttattatctaaaacagaaatgaaccccatttcatcttttataactaatctaggtaatccttttttatataagatctgcggtaattgtttatccgttcctaaatgaactacgttatcattcgtatagccctccagagtataattattggcagggatagcgtaagtgagcataccataaaaactctttaaatgggaatagatctcaccgcactgttttctagaaacgttgtttctgttataagtaactaggagagtctttccgaacttcccttttgtatgcttctgcagaatagcaaacctagatataaagatatccttaaacgtcgtataaagcaaactgatttcctcgaacgacagagaattagttaaaggcaacttactatacctagtaaaaaatggatctccgcaaggatcgatctctaatagatccacatccgataacccatcattgactaatccgaaatcatacctttcatctgtctctacggtttgtacgtccggagacatcctcgacatttcactttctaagaattcaatactgggcatctttatgtttttgatttccattaacacttcaggggtggtgaatttcgaacagcaaaaagaatacatccctccgaacataagaccggataaaaaagaatatgcgtggatagtctgatcacatgacgttttttcgataaataaatcgctctgtaacagttctacaaatttttcataagttccggaaaaacccacggtcgaagccttgatcttggacgttacacctattgaactgtttctgatatgtttcagatgacaggttatcaaagtctcttccaccgacccatcttccaaaacaatctcctccaattgaaccgttttcgataaatcctgatccgcgaactgagaataagtattcagccgatgaatattagatttaaaccacggttcaatttctaaggagaaattgccaatttcacttttgtagtcctcgaaagtcttgttttttatcagaaaataaaccggaaacacaaacaagttatttctgttggtaacttcaacctgctcatgcagtgaacggaaatagttctttacctcgttatgcgataaaaacaagcgggtcgtttctatttcgttcatgggatttctgatgtacgaagcgggcttcacaaactgatcgacatactctataagctccggcttcaacggcaaaccaaattctatgtgctttaaaaaatctccgaacgcatgatccgcacaccttttgttgtttacaaagattatccagttgttatcgacttcgcaatatttagacagcacgtcgtcgcaaatcaaggccgaaagtacgtctattcctctcttcacgtccttattttgagtcagcggattaaatgaagtcaccaaagcattactctgcgtgggcgaacccacacacacgatacacggaacaattccgtcctcatacaaaggggttttatacaacgcgttataaaaccaataaaaaaaaacaacagtgtgcagaatatgtcgtaatattacacccgcctcgtcgataactataacactactctcacacaaatcaggtaactctttagttttgcatgcgacagcacccaacgccctatccgctatgtcggagataacattccaatagatggacaggtcttgcttctgttgaatttgaatcgacctctcgtcatttgcaatataactttgacgttcgctcatagatacatgtgaactattaaacccaaaagtcttaaaaattgttttaacttgcgcggatttacttctatttaaaacaacgctcaaattctgagcggcgatagatgtcgttgcagtaacgatgcaatctaagttggccgctaaggtctgaatgctgttcgttttccccgccccggccgtaccggttactaacaaggccttaaacggcaaaaaaggcagaggttgagcgaattcatcaatacctatgcacagagcatcagcaaattcgctgttgaactcggtttcgggatccatgatgtggcgaaaccaatcttccggcagacgcccctccaagcgtctttctgataacgaagccaccttatctacaatcaactctattttgggagccgaagacatgttaagcaaaaacttattatcgtatctacctccgaacaacgaagagatagacatgatttatccctcggagcagataatgacttttattgaaatgctacacggacacaaaaattttttcaaaggtcagacaatccacaacgctctccgagattccgccgtactgaaaaaacaaatagcctatggagtagcgcaagcccttttaaacagcgtttccattcaacaaatccacgatgaatggaaacgtcatgtgaggtcatttccgttccacaacaaaaaattgtcatttcaagattattttagcgtatgggcccacgcgattaaacaggtgatcttgggtgatatatctaatataattaattttattcttcagagcatagacaacagtcactataacagatatgtagactggatctgtactgtaggaatcgttccgttcatgagaaccacccatacggccccgaacttatacaatctcctacaacaagtgtcatctaaactaatccacgacatagtgcggcataaacaaaacattgtaactcccgttttactgggtctatcttccgtgatcattccggattttcacaatattaagattttccgagaccgaaattcggagcagatttcttgttttaaaaacaagaaggctatagcgtttttcacgtacagcaccccatatgttattagaaatcgcttaatgctgactacgcccctcgcccacctttctccagaactaaaaaaacacaatagtctgcggcgtcatcaaaaaatgtgccaattattgaatacatttcccataaaggtgctaaccacagcaaagacagatgtaaccaacaaaaagataatggacatgatagaaaaagaagagaaaagcagcgacgcgaaaaaaagtttaatcaaatttttactcaacttatcggacagcaaatctaaaataggcattagggacagcgttgaaggatttattcaagaaatcactccctctataatagaccaaaataaactcatgttgaaccgaggacagttccgaaaacgctctgcgatcgacacaggagagagagacgttcgagatctgttcaaaaaacaaatcatcaagtgcatggaggagcagatacaaacacagatggatgaaatcgaaacactcaaaacaacaaaccaaatgttcgaaaggaaaatcaaggatctacactccttgctcgagacgaataacgattgtgatcgctataacccgaatctggaccatgacctcgagaatctctctttatctcgagcgctaaacatagttcaaaggctcccattcactagcgtttccatagatgacacccgatcagtcgcgaacagttttttttcacagtatatcccagacacgcaatatgccgacaaacgaatagaccagctatgggaaatggaatacatgcgaaccttccggttaagaaaaaacgttaataatcaaggacaggaagaaagtatcacatactctaactatagcatcgagctgctcatcgtgcctttcctaaggcgattcttaaacatttacaacctcgaatcgattcccgaagaatttctctttctatccctcggtgaaatcttattagccatctacgaaagcagcaaaatcaagcattatttaagactcgtatacgtccgagagctaaatcagatatcagaagtgtttaatttaacccaaacgcaccccgaaaacagcgaaccgattttcgattcgaacattttctccccaaacccggagaatgaaatccttgaaaaaattaaaagaattagaaacctcagacgtattcaacatcttacacgtccgaactatcctaaaggtgatcaagattgataaatgtatatcactcgcacgacatccgttagtaaatataacagtaggagatgacggaatatggttccacttggaagacggaaccatgatcaacggcctggagtacaagaccatctgcgaaaaagaattgggatttcaaggcttcatcggcatcataatactagactcggaagatacactgcaagaactgcgactcaatccctttcagttcaaacgcagactaatccatatgaaagttgatacgccagaagaatttatgctttgcggactagtgttcgcattagaaaatcttccactgaagcaaagcaccctacacaaactaatcgctaagctcgttctctttccagccctatctccgataacgaaaatattatttaacacgtgtgacacgttggtttgtacactaagacacattttttttaacgaacacgcctcagaaatcctccacaaggtgcctctgatgattagactatacaatgaaatgaaaaacacgcatatagaagttttggaactttattttaacacaaaacgtagtcacaatttcatcaatttatcattagaatctagacagctgcaagacagttctctccaagtcatacaactagcaacacaattcgcacaaactttttattcgaagaatggagacacatctagctaagtctcatttttctatgttatgtaaagaaataaagttaattcaaatgcagtaaatgaatgtgttcacagagcatcctgttttcccacctaataaactgtgtctgttcaacgtcttcaaatttactctccacccatctcctcaacactctcagtgtaacgagaatgtaataagaaaagtttattttgtcagtcaacgcaattccacgtgcttgtctcacaagctgtccatcttcagacatcacggccgtatatctactgcagtccagaagtccttcatgatattccagacaataatcattaggatcgaactcttcgatccaataagaaacattatacctattagctataaaaacacacatcatatcctgaaaataaacagttatactggcaaagcaaagacctgtcttattggtccgaatacatgcagataaatatttactcgccgttactgtccagtgcgcttctttagattgtgacaacccactgctcaaaaaaaatctggcgtagacgataaatccacagcgcgaaatttccgcacactgaaatgtaggtctttgtttgatttccgtagttttttcccaacagttttctacggccgtttgcagtaaaggcatgacaacatgtgtatctttaccatcacaggttaaataaaacatgtgtaagtcccgcactaacagccatcgcattcccattagggtacatgctcgctgaaaagcggaaacaaaagcatctaacataaagatcaccgcatcgaataaagcgtacgatctgtgttgcagccttgacataaattttaaaagcagatcgatttccgtggcgttttcatcaaaacatggtaaaaaggccttaggaaccgtggacttcaataatagcctcagacaatctggcaaagtcactacatacatatcactgtcactaaagaatagatgtgtgtcctcgggacctgtctgaaaacacagggactcacttgaaacatactgactattgaacctgaaacgctgcaaagaagtttcacttccaggcatttcaatacttagctccctgactacggggaccgcgtgtctaccacgaggtcccaggataggcgccaaaccgcaaaatgaaagaatttcgcggcagatataagttgtatccggaactcgcctttctaagtccgatacagacaaaagccacagatttggatatcctataaaagaaactgatctttcattcccaaagggccataagtcgggaccgatgtattcacaaagctgaactaatacctgtttataaactccgaatatcttctcgtgcaggaaagcaaacacgctctgcagtaaaagcaaacacaaatcatcgtcgaacaataaggcataagcattttttggcgtcactaagagaacttgctcaccgccgaaagcacacacagaaaaagaaaaaatttgtttcattttttcacatacggcctcaccggtgtccgtgtgtgaaaaacaaattttcacgtcagacacagtcagcgaaaagtgaaagtccatcacactgtatccaaagcgaatttttttggaagcctgtgtacattcgttactcaaaagatgcttcgtgtccaaggccgcgtagtctccgatacaccgtaagataacaggtaccgtgtccagaggcaacatgagttcctcgccacaaacgtatgcttccaaaatctctaacccgtcatctccaagaacaacggttagaggcacgaaaaattttgaaagtgtcctaacaagctctccgttattcataatgaggttgctgattgctgctatttttttgtccatcatattactttgttcctgaaggtcccaaagcattgtttcttttcttgtaacttctatctcatttaacgattcttggtctaggctctgtcccctaatcaaaaacgtttttaacgaacgagtctccgcttctaaaaacagacactgaaaaatcggtactctgtagatcttattctcccagtcattgtacacacaataaaggctaagatgacacgcacacccccggagatgcatgttgcccgaaaactccaacttcactaacggagaggcttatatccgagccttgcagtttataaattgtttgtttccgccttgctctcgaggcctcggtgagggctttacgtagttctttgcaagtcttaagattggtgcgcgaaatctcccaattgtctagcatgttctccatatcattttttgttagattgcgatacgccttcccgggaatgtaccgaggtctgctggcggacagagtcatattaaatgcacatttaaagaaaagcctgaggatagaaatgctgaatttttctatagagaacacacccgtcacaatccgcatgcctctcaacttgttaaaaagctgcagagtctgcagactgtatttttgaaaaaattgcacatgcaccgtaaacactaattgcattatttgtaagatgtcacttgacctcctggccgcacacaaaaggagatcatcttcagaaatgtcagtagtagtatccgtgcacgatttcagtttcaaatcttttcggatcatttccgccaggaaggccagatctattaacattccccactcgtaaaccccagaaatgtcacctagaacaaagtactcgtcgcacagaaaactcttcggcagcatatagcacttaatccgctcacaaaaaactctttcgatttccgtgctttccacaccggcagacacacatttttgcaaccagacgttcacaaaaacatagcgtttgctttcattttttagatcatatacaatgtccgatgcgatgaaaatgtcaacgcccggagataaaaaagtcgctctgaactttcccatgtcggtaatatagtccttatgtaatagctgatcaccgttttcataaaaatccccgttcatgatagtttctctgctacttataatctcttggaacgtcatgtcgtcacccggcaaagtaatcttcttttcgataaaatgacactcctcaactagaatctgcaagaaactcagaaaaacctctttgcgcatcgggaatccatttccaacgatgtccaccttaatagaattctcacataacagactgcatagcagaaataaactatcagataaacttgtaatagtagtcttttcgatataatgcctgtaccgaaaaagagacttcagtacggaacagaaattatatttatgcgctccgctgcactttccgcggaagtcgatgcaactctctgagatgatagactgctcagcgacactccaatcactgcacggaggtatggcaataggtgccaaaggatcatagcttctaattaatacgggattcatgtaaatgtatatatcttcatcgataactcgcctcacacgaccaatggattgaaatactgaaaccatgtccggccctcctttggccaactgaatgtaaacaaacaaagagctgaaataaaccggttcgaaactgagaccgacagtcacgacggacgtataaatcactacgtcataccgtatccacgattctatggaagagcatttcccttgtttagacgtcaacaagagaacttttttgagtggaaaccgagaccgtatcaaatcatacatgtattccgctgccaacacggtgctgcaaaacaaacacaatttcttatcccatcgtagcttgtcttccaagcgtgcaaaaaaagaaaactctttaccaaaaaacgtgtcacaaaagtaagcgatcctattggaaaacatcgcggacacaaatgtatttctgatgagggcgatttgagtatctggcttgaacgcggcaaaaaactccaccacatgccgagtcagcgtcgcatccatggctattacatgactggaatttttgatcagcgataaaaacttacaatcaacttctttggtttttgtcatcgttttggaataaaactgctttataatcgacataatttcatctaatattaaaacatcgtaattttctgtaagacgatgcaagctttctatctggacaatgacttttctgttgtttatctgccgctccgtaatatcgcaatataattcaaaatccttcaacccattgagagtaaaacggtgcaaaatttcagcagcgaacgttttacggcaagaaatcaaaaggacagatagttccctgggtacctgtttcaaaaaatgaatcaaggctgttgtttttcctgaacccatcgctgcgcgaaccagttttatcggctgcctgacgttttcaaaactcaccgccgagtcggcttgagaataaacggtgacattgtccggaaatcttacatcggacaaactctgaccgaaccactctgagaacagagtatcgttctgaaacctgttctccatcacagagctggtatggcctccagtcgtgtagacaccattaatttacggatctggctggtctctataatctgtgcagccttgtcattcataaacgtcacggtctatctgatagccataaactttccaaatttaggatttccgtgcgcctactttgaaattaatgacctcaaagcggttaatctctccgctaacaatcaaatatatcagatgacgcatcaactttacataaaccccgtgcagattatatgctacgtactgataatggctatgttattcctcctgattattatttattacattgtctgctgtgcaaaagtgttctcctctaacaaaacatctaacgttaaccaaacaacgagggatattacctggatgggggacacgtcatcctgctttcaattcatcttaatcatggatacatttcaattattcgtcaccgccttgtctttcagactggtagccctaggcgcatttgcctattgcatcttcttcgtgtgtttcaccacctttaacgttacgctgataacgcaatttcaatcagcggataagtcatttttcgcctttcagaaaattcatcctaacctaaaggggaccgtacaattcaagaccgttgttatcaatctaaccgaactcatgctaggttactctacaatgtttctcggcattactacttgcctgggcgtcggaaatagtatctacatacgttccataaccgttgcttactcttccatcaatacctttcttgtcatggcttgcatatatagtatagtaatagaagctgtcctggttcgctacgttaaacccttgtttggctattacgtcggtatgttttgtggcgccgtaggcctatcttttcctattctccagtacgaaactttctttgaatccgagtggagcacaggacttattatcaatttagcggtcatcgccataatttcgatcggttttataatttgtcgacttgtacgctacctagttaaaaagaagcgtcggtacaagcaactagttaatactgaaagctcgagcctaatggatgaaaacgagtgacactttattacaatcatgtttattgtcaaatagccaaaaaataaaaaaaaacgagcgtgccgtaaatctgcgtcgtctatcatttttttgatttacaaggcaattttttttcagcttccgtatcacacttagcaactactttttcaagtaagggcttttcaagatctgccatcccttcctcttccgattcggtatcggttaaaacagtaaattcattcgctagtaatataggatttcccttgtaatcaatcaaggtgttttcggttttcttacacatgccgcaagatactggtttacagcactttgcgcccatacctgtaaactggtctgcttgcaaatattattttcccacagattgcatatgtctgttataacacaacaagtaaattccggattcggtgctaccggagtcacaatcaaggccaaaggtatttcttcttctatatattctgtctcatcaatcaccaaatgcaaactcctttcttcctctgttcttctcctgaagaaagccgtcacaatgtgaacagaaggcacttccgtactttcgatatattctggattattatgatcattaatataaaactgagtcattacatattgttgtaacagactctgaaaaaaatacctgtgtttcggatttacgaatacattcacagtaaacacagccttctgaaacacagacagcttctgctcacacaagtcgctcttacaatcaaaaacgattaccgtagatttctgtgtttcgttcaaacacagcagttgtttgatatgaggtgccaaaatagctggagtggggcaagtacgcaactttctctgaggacgatattgaaaatcatacgtcattaaatattctctagatgacggaatcttccctctttctcgaaactctatgacaggcaccggatgagataaaataaaatccgaaaaggatttctccgtggggttttttaatagttcagaaacaaagtgatcttctttatcccgtaaatatttatatttgaatttaatctcaaaaatcagcgctttttccttaaccatcaggaatccatcctcattgaatgaaattccaaaacacgcgtctagagacgcgccaaaaactccagaagaaggatcaagcagcaatcccaacgtttccttaacttcccttttaacgtaaaaggtcgctacgaggtgtctaataacacgctcatgtttcgcgccataaatcaccgcttccccaaaaaactgctgtcctttatactctaaaaaacatcttgtcgtatagatgtcatacaacttagtcgccgtcacggtatatttccgtaacgcgtgccagaggggattttccgactgcccccgagtttcacgctctacgattttaaataacttgttcacagatacacaaggcgcacgacacagagcagaacacaataatggacagtaatcatacagcttgcacaattcactcagatccatagaaatgtcttccgatccatccactcttgtgccgcacaaaaactgctgcatttcctcaataagtttacggcccagaatgcaattattgttagaagcgttatattttattagcatgcagtaaacatgacacaagcgaacaattgaaaatggaacttgcttgatcttttcccgtattgcatacagtttatcaagtaaaaacatggttaaaggctcttcttcggccacagaactcagtgtttcagatatttgatcaagatccattactatatcacatatgaaagagagatgatgtatctttatccagatccgcagtagaattgatcaagaacaactctctaaggtcatgtaaaagtttttctccatactcggacgactgtagagacgcgagaccctctctgattggctgacgtctggtaagtttactattatttaaaaaagttgcctcaaaaaggtctcgtgacccaaattcccctctctcatctagaaaatcgtatagtttttcatatatctcaaccacgtctcggtaaaacaataaccctagtaatactacatgctcagccaatactttacagcaagcatccctgtaagcaaatggatatttgagaggattcaatcgacaggcctcgttagccaaggcaaacaaccttttctcgtagtataactgagcttcgcggcatccacgtttatccgtcattcttagcacacacgataatacaacctgggcaaaagcacacagatccaagttacagtgtctaagaggattattttcaccatcaaaagccccgcacacattgaccaatatcattgcattggcgacaagtggtcgaaatccaggattaaacatgtcacagaatttgttacgactaattggcacaagttgaagatttttgtcatactctttagcaatagcacacgtgccgttataattgggatgcatctcggacaagctgtaatccgccaacacggcatcaaagatgatctcttttttatgatttaaaaatatattcataggtgagatatcgaaatgattaattctacatttcagatttagaaaccttacagcatcagctaacttacaaaacacactgtagtaattcattacattcctgacatcccaatcttcgaacttatggagatcaatatcataagtacgtgacaaagacactttatgactcatacaaacggaatttgaaatcaataggttattaataacacactcgtgagataataagtcggctcctgattttgcacggatgacaccagctatgaaagccgaaatgacactctcatcttcattggccgtctttatggccactttatctagatcaaacaccttcccgtaagcacccactccgagaactcgagccatagttttctcaggttgacaaaactgtccacagagttctttgttgtgagggacgtagaccactgaatacgaacgctcttcgctttgcacatcaaacaaaaacggcgagctgatcttttcgaaaattctcaggttacacaaagtttcgccgtaggccgcaagttcagcattctcactcatgtctagaaaaatctgctttgaagctataattttctctagctccagtttccatttgtttgagctgaagatggtgtgggcattcgacagtttcatcggcgagtctagaagcgactcgtgacaaagcaattcctctatcgcagaacaatcgcaagcaatttcgtgtttacattttccgaaactttcatcgagagaagcacttcgcgactcgcattcagactttacaggcgaagaaagtgtttccatatcactgcaggcggaaatctgtttctttaagggagagctatcttcggcaaaaagttttcgtttaacaccttttccgagtccctcatgttttcttaactttttcctgactggtggtaaatttatcggctgagttttttgaccctgaggtgtctccacaccgttgtccataattattctaattcagtgcttgttataagagtttcttttatatcattactgactgctttcacttccgctgccgtatcaattatttcgtcgacgtccaatttctctagctgctttaaagctttttgttgcactcttaaaaaactcttctgcttatccaaaaaaccactcaaagaagatattacatgctgttgttctgcattgtccgatttgatgatctgcctagcggcgatcatatgctgatgcacactcaatggatgtctctcccctaatctaatctttaaagaatctcgatgtctcacctccaaatctttagaaatggactgtctcagatagtccttcaaagacattatatgtcgaacttgacactaccttccgaaatgacaagcgcaccgagcagcttacgaaggtcatataccggaaatatggctgagctctttgtacctggcagcatctgagttgtagaaattgtcgtctgcgcgcataaacaatcctttattataattggactaaaaacagaagtctttaagtcaccagaaacgtattctagactaagtttgttttgtttatataatgcacaaaagatacacatctgtgacgctaccgataaaacagaaacttcttgctccgcaaacttctgttttaagtcgtacaggagtgacctgattcgacgacgagcgcgttctgaaatctcaagcgccgaaaaatcaaaatctgagtaccaagaaaacacgtaagcttgcacaatgccaaaaaacagtccattattttggccgcattcgtacagatacggaggcaatagatttggaaacgcggcattatatcccgtcttactgtatccgaaacaactgtctgactggcaaaaacttttaggaccacaaaacactaaccaaagtaaacattcaagatcacgcacatcggtatatcctaacagattaggggtctcggcatactcgagaatttttttaactaacttcgtcttatcgatcatcaaagacgtttcaatgtgtttttttgtatacaaaatgtacttccccgaaatggcaacttgttgatcttgagtccgcaaaacgttctgcagcaaatacgttctagccatcttctttgattttttgttcgcaaacgacaaagccaaattatccagagcggcatcgatatttaactttgtttttttttcaccagacgtcacacccgaaggaataacgctcgtcacaaacataaaattctgtgtaggcgtttcgatcatcctcaacctagcgctcggggctgccgaactacacactgaaaacgcagtttttaccgcttcggcaaaaatctccttatcttgctctgtgaggttcgccgccgcctgatagaccgccgccaacgtaaggtcgggctccatgctacgtacctgcgacataacccacataaaaaataactatgaagcgatcatatggaaaggcgaaagagactgctcgacaatatctaccaagtaccccaacagtgccatcttctataagaagcgttttataatgctcacgccagaactcggctttgcccattcatataaccaacaggtaaaacctctatatacattttgtgaaaaacagcgacatcttaaaaaccgtaagcctcttactatactaccgagcctttcgcacaagctacaagaaatgaagtttttacccgcttccgacaaatcctttgaatcacaatacacggaatttcttgaatcctttaagattctatatcgtgaaccgctgttcttgcaaatagacggttttatcaaagatttcagaaaatggatcaaaggagaattcaacgactttggagacacgcgcaaaatacaactggaaccatttcagaagaacattctcatacatgtaatcttcttcatcgccgtcaccaaacttccagctttagccaatcgtgttatcaactatctgacccacgtgttcgacattgaattcgtaaacgaaagtactctgaatacgctgaaacaaaaaactaacgtattcctagtcccaagaagacatggaaaaacgtggttcatagttcctattataagttttttattgaagaacattgaaggaatcagcatcggttacgtggcacatcaaaaacacgtatctcactttgtgatgaaagaagtcgagtttaaatgccgccgaatgtttccagaaaagacaatcacatgcctggataatgtaattacaatcgaccatcaaaatataaagagcacagcacttttcgccagctgctacaatacacacgtaagtactatcaatttaactttattttcagaaataaaaaattaatacataaaacacacaattagtccattaccacacgcttacacacaggacacgacaaaacaatcagcctgctcagagctgcgctgatcctgactggtatccaattaacacattttaacgcataagggtcgtcaccgaagtacccatgagcgtaagaattaatgtccagtgataacgatgcttttattttgggatacataatatctatcttattaatttcctgatcacagagcagagagattaactccggattgttaatattagccatttttttcttacacgatgtgtagcaaaaacaggtttcttgattagagacgcaccctacaatctgtccagcttgcgatacatgtttgttgtgatctttacaaaagacacaatcttcggattcgcaagctatcatatcaaaaataatttttgccagagatggaaaggtggatttgtcataacaagttaggaaaagatcgtaagcgagtgcaaaagtatagatatacagatcgccaccatttttcagacaccatgctccacacccacctaagggagtcaatttattgtccccggacccttttaccgtgaggcgatttgcctcttcgggacacacaatagagcaattttcataaataacctccggtgtaacacaacgcatgtttgtaacacagtcggaattatatctcggaataaagcccaaatcgataggggttatgcttcccaattccaatatatagtaatagagcccttccggaactgctttcttattaaatttcatttttccggttaaaaactgcccaaaatgtatgccatttaccgcaaggctgaacataaattcttcacttcgcttgaatattacaatctcgcaatgcatgcaaaatttcttaggcttattattcaacgagaatgtaggagacgatgtcgcaacgctgcgatattcgcgatagaatgtttttttacaaattctgaaccagttacattcattctgcagaaaatttctaagataacccaaatcgccaattgaaaaagtcgatatcgccatcagtaagcgcgaatttaccggtgattgcaaatccgccgggtagcacaaaatccaactctaacttttcagatacatacaaagcacagcaatcaacatataattcccacgacttattctgtttttcccgacacgtcgaatataaattgttagtcgagtccaaaatccattggatcttttccccgtagatcaccgatcctttagaacagtctattaaatccccccaaacttcatcttgggctaaaaaagattttcccccgttttgaaaacctaggaaacagataattgccttaataatgcagctgtctaaagttaagtttaaaatccaaaaatctttcccgagctgcataaatgataatagacgatcaaagctgaaattatctggaaaattgcaattaaatttctgtttaaattgcctattatgaatctgaagcgttttcacgatgtgtgtcaataccctgcttccaatatctcgcaaataccgattagttctatcccaaaaatccgcagcgttaacccgctttagctgggaagcggacagtaaattattctcgatctgcatctcgcgggaaaacgaaagctcgtaccaacataccacgacttgatacgtttgcgtaaaatccaaaatttttttgcatctgactttttgtccgaaccaactatcgcttaaaaaagattcggtcattttttcgttagcatgggcgggaaattgtattggcttttcattaccgggcgcctttaagcctctgacggtagagggtggctctaaaggtccctgctgaaaaaatagacaacgtttttcctcatcgggtgtctgtttattttcacgtgaggttagttgatagaaatcattagcaatatttttagctgatgcttccgacggccggtttgacggaggtctgacgcatataagatcgtagagtctcagcactatttcccggtgcactaaccgcggataaaccaatttcaaaattacagaatcgatatcaaaatgaaaatctactatcggaattgggatagtcattaccaccaaaccggtaaaaacttcgtcagagtccgcatcctttaacacatctttaaactttatttcacgtgaaatcacagtaaactttaatttactccattcagtataatgcatcccactcttaaaaaatacacaccgaaaatataaagactcgatacaatccactctcatcggaagacacacatctgtcggcaggcaaatatgagccggatacactccgccttgatattgatacagggtgtcatagtataagtgcgtttccatactccaatctcatcttttttagtaaactgtcttctcgtttccgacgactgacgcgaattacattactgtcataaatcgttcctttagcgtgtcctcctataatcaactgaacaaaaagacgacttatcgtcgtcagaggaatcttattgaaagttgagttagtaaaaaccgcgttaaaagtataaaacacagcgtcttccacgttttttataaatttcccatctttaataatgctatcaataatggcagcatatcgttccttgttttccatcaaaaaactatatacataagataacaagaccaccacgacattaaccgtttcaatattcggctcacagatcggttctaagaagcagtctgcatatgcaggcatccaaccgctataaaataaacccgtttttgcacagacatacccctcatgcgtgttgacaatggtacagtcagtttgcatatcacagtggtgaaccgtcaaacaccgcatacagacaaacacgtttccaagtcccaactcaaacgtgataggattgtgtaaattatacatctgagaacattcggttgtacacatctggttattcttatgtgtcaatatcctgcccgttaccctgtcgtattttcgcggcaactccattttgtcgatatattacatcgttaaatatctccaccgcgagattatcaaataggatggccgctgaatccaccctccgaggcaaagactcgacctgttccactataaaattgcaatttttgcttattttatcaattattttaaaaaggtcgtctttcgtttcacagttctcaaaatcgtcttttatcccgtttaacgccgaattcattcccctctcagagtatacgcggacagagcttcaatctgcttattgtcgacgagagccactttataaagaaagacgcgttcagcacgattttaggtttcctgccccaagcatctaccaagatcctatttatatcttcgaccaattccggaaaccattcaacatcttttttaatgaagctgaacaactctccgtttgaaatgctctccgtagtttcttacgtatgtgaagatcacgcccatatgttaaacgaacgcggtaacgccacagcctgttcttgctaccgactccacaaacccaagttcatcagcattaacgccgaagttaaaaaaacggccaacctcttcctagaaggagctttcatccatgaaatcatgggcggagccacttgcaatgtgatcaacgacgttttaattacggaacaaggccaaaccgaattcgagtttttccgatacagcaccatcaataaaaatctaattccctttttaggtaaagatctgtacgtatacctagaccctgcctatacaggcaaccgccgtgcttctggcacaggcatagcagcaataggcacctatctagatcaatatatcgtctacggcatggagcactactttctagaaagtttaatgacaagttccgacacggcaatagctgaatgtgccgcgcatatgatattgtcaatcctagatctacatcctttcttcacggaagtaaaaatcatcatagaagggaattccaatcaagcttctgccgtaaaaattgcatgtatcataaaggaaaacatcacggctaataaatctatacaggtgacttttttccacaccccagaccaaaatcagatagcacagccattttacctactcggtaaagaaaaaaaactagcagttgagttttttatctcgaattttaattcaggaaacatcaaggcgtcacaggaattgatatcgtttacaataaaaattacctacgatcccgtggaatacgcactagaacaaatcagaaacattcaccagatctccgttaacaattacataacatacagcgctaaaaaacaagcctgttccgacgacttaattatcgctataattatggcgatttatgtatgctctggaaacagttcagcctctttccgagagatttaatcaccctttagacacgctaaaaacagacgaatcacatccgctctcgaagcctcgacgtccacctggaaaaactgactgacaaatacgagagctgacttaaagttatattcttctgtaaataaagtaagcaccttagtcgcacacacaagaacagagagaggagcattcacataagacttataatattcctgagctacacgattaacggtttcgtggcttctttctacggtaggcagggaaagtttgtgtttgtaaatggcattgaagatgacagcgatacaataacaattattcaacattactctgtgttgaatgaacgcactggacatcaattccggcctaggacgtacagaaccagatatctcttcccacaaaccatcagcccccagctgaaatagacaagcctgggcgaggacaaagttttccataatatttccttgaataaggaacacttgctgtaggcgagctagttctgcacatttttgaaaaatctctctctctgtccgcgctacgatatcaacatctgaccccagcacatagtaaatgtacgacaatctctctctgaaaatagacaactcctgcaccgacagaagcgtatctggcaaggtaaaaggagatgtttccaacacatctgttaaaacgtgcgtcagcaaaggcttattcgtcgtcgcgatacccacggcgtgcttccacttcaattccatgggtgttgactgtcctctcattaaaaataatttaggaatttcgtataatctatatcgaccatcggcaattctctccccgcactctatctttatttttacacaatgtaaaatacccgtcaatgcgtagattatatctccgttcacatgccaatatatggtaagtttaccgacattccgattaacacaaccagaaataaaagcgcataggtcggacatgtagactgttttcgagtgcaagttaagcagtttacttaactccggattgaaaatctcatggacagctatggtttccgaatctaacctaatcgcgcaatcgaaccattcgtcggccacgagtacattcatgttttcaccttagccgtcagagtctgaagtaatctggcgacttcattccgcgtatttatggcagttgaggtttccgctaaatattccaacaatttaatgaaaacagttttatttttctgttccccacttttaacgataaaacgcaacacggcgagcgaattagcatttcgccccatgtgatctagcttcattttcttctgcctagcaatgattttcggaacattgttggcgagccgcgtcccaaccaacgcacacccgtgtttgatttttgtatttgctacggagttcttattaaaatcaaacagaccattcgaaattaaatgtaacataatatcatgcaccttgttgcgccgagagtgcccgtaacccattaacagaccgagacgtaaaaaaataagaaactgtttaacgagaaacggaatctgatgtagatttcgctgttccaataaaacaagcagttgatgtaaatccatatcaaagactaacccgggaatctctcgaacgttatttaattcctgaagcaaaacattttgaaggtcctccccagacacccgaggaataatacccgttcctgctttaaaccatcccacgttcactttgttagcattagaaatcatgcacggaaagttagtgatccaatacacctttttctttctatttctcacaacatcctgattttccagtccctgtaaatccactgaattattgctattgcaaacgaacgccggtaaaaatagatctcggatagaaacatgcatcttataaacgcctaaagcatataaaaagtcgcagtaaggtccacgtatgttgatattcaacgaactcatatctaaatcatcgtttgaaacaaacgtgcttacggtaaacgcaggttctttaaacgtatgcttgtacatgacaaaactgtgggtcatcgtcttaggaatgcgatgatatacaaagttagccctttttgaaatggttgcttttaaattcatgactttgttcgtattaaacgcgttaagagttaccgcgccatgcctcactgaggtaatttcagcaaaatcgataccaccgggaacattaggtaactctttacgtttaggctgttgtgccacaaagataaaatctggtctcacgcctggcgggagcgcactccgagaccgcttaaacgacaatctcgaaattactcgtatgtaatgagccgtcaaaacgttttcttcgtttgtcttgcattcgtccggcaaactgtaatcgtaatacaacagaagcaaattccggaagattaactgagaagattcaacgacatacaatgttttaccgtaaacaaagccattcaaacacatttctcgcttatttttttttaccgtaaccttaatatttagatacaacaattgctgcttaaattttgccaaacacaacctctgtattgcaggaaccgccttagacgacatcctcagggtcttgattgcgtattgtttatagttttgaattttctcgtagactacattaaaaaaatctgtcgtcacccgattatgtttgactacggttaaccaaagcttatgcaattctaacataaaaaaattttcccagaaccacgaatcaacagtaccaatatgcggcttgtgacgaaaaccaaaaagcagtttaaaatgaattatgactcgctgagctactttagggccaagaagcgaaattaaatcatttgtacactgctcaatctcaatgacagtaagatggcgacacaggtagcacaaaaaatacggatagtattctagataaatagaattctgcttaggatacactgtcgccacatatctatcgctcatcgacaactcacacgtacacaatacattcggtagatgtgtattccactctttcagagataataaacctctgaacacgtgtgaagcatagtaatctttcataatagaaaacttaaaaaccggaatgtcgctacaacgacatcgactggtatgaatatataagatcggacctatgcatttacagccagatttcgacaaatagtcgttggtgtcccactcttcacagaagcatggcaccgcaactggtcctaacaacagacgacacaaggcaattttagccctgtctttatcgtgaacgatatttggcccggacgtttgaaaaattttctctatgattgactcgatcttttccagaactacaggcatggatcgcgctaaacgagtttcctcgtcgcgagacacttcagcggtcagatcacacgaatctataaaaactggaatcgaccgtgcacaagtggaaccaaaacatgaattaactattaaagtttcacaattaccggtgtgctgcataacgccgaaacatggaaaattggcaggcgaccgaaattttacctaagatcgaagcacctctaaatattttcaatgacattaaaacatacacagccgaacaactttttgacaatttgcgaatttatttcggtgacgatccgagccgttacaacatcagttttgaagccttactcggaatctactgcaacaaaatagaatggattaactttttcaccacgccgatcgccgttgcagcgaacgtaatccgcttcaatgatgtgagtcgaatgaccctcgggaaggttctcttctttattcaattacctagagtcgctacaggaaacgacgtaactgcttcaaaagaaaccaccatcatggtagccaaacactcagaaaaacaccccataaacatatcgttcgatttgagcgctgcctgtctggaacatctggaaaacacatttaaaaacacagtcatcgatcagattttaaacatcaatgcgttacatacagtcttaagatctttaaagaattcagccgattcgctcgagcgaggtttgattcacgcattcatgcaaaccttattgagaaaatctcccccgcaatttatcgtcctgaccatgaatgagaacaaagtacataataaacaagctctgagccgagtacagcgcagcaacatgtttcagagcctgaagaacagattgttaacgtcattattttttttgaacaggaataataatatttcatatatctatagaattctaaacgacatgatggaatcggtcacggaaagcattctaaatgatacgaacaactacacttccaaagaaaacgtccccctagatggtgttttattaggaccgatcggctctatccaaaaactcaccagcatactctcccagtacatctccacacaagtcgtctccgccccaatctcatatggtcactttattatgggcaaagaaaacgcagtgactgcgattgcataccgtgcaatcatggccgattttactcaattcaccgtgaacgccgggacagaacaacaagacactaacaacaaatcagaaatcttcgacaaaagccgcgcgtacgccgacctaaagctgaacacgttgaaattgggagataaattagtcgcattcgaccacctacacaaagtttacaaaaacacagacgtcaacgatccgctagaacagagcttacaactaacattctttttccctttgggtatctacataccgagcgagaccggtttcagtacaatggaaacacgtgtgaaattaaacgacaccatggaaaacaacctacccaccagcgtttttttccacaataaagaccaagtcgtgcagcgaattgattttgccgacatattaccgtcggtttgccatcccattgtccacgactcgaccatcgtcgaacgactcatgaaaagcgaaccattgcctaccggccaccgcttttcccaactatgtcaactaaaaattacccgagaaaacccagccaggatcttacagaccttatacaacttatacgaaagtcgacaagaagtacccaaaaacaccaacgtcttaaaaaacgaattaaacattgaagatttttacaaaccggacaatccaacactgccgaccgaaagacaccccttcttcgatctcacgtatatccagaaaaaccgagccacagaagtactctgcacaccaagaataatgataggcaacatacctttaccgttagctccagtctctttccacgaagcccgtacaaatcaaatactggaacatgcaaagacgaactgccaaaagtacgacttcaccctcaaaattgtcaccgaaagcttgacgagtggctcgtacccagaattggcttacgttatcgagaccttagtgcatggaaacaagcatgcttttatgatcctaaaacaagtaattagccagtgtatttcttattggtttaacatgaaacatatacttcttttttgcaacagcttcgagatgatcatgctaatctctaaccacatgggcgacgaactgatcccgggagcagctttcgctcactacagaaatcttgtgtcgctaattcgcctagtgaagagaacaatctctatctccaacctcaacgagcaactttgcggcgaacctctggtgaatttcgccaacgcgttgttcgacggacgtctgttctgcccgttcgtccataccatgcccagaaacgacacgaatgcaaaaataacagcggatgatacaccactgacacagaacaccgtaagagttagaaattacgaaatatccgatgtgcaaagaatgaatctaatagattcaagcgtcgtctttaccgacaatgacagaccatcgaacgaaaccaccatcctgagcaagatattttacttctgcgtactcccggcactatcaaataacaaggcctgtggcgctggcgtcaacgtaaaggaactagttctagacttattctacacggaaccgttcatcagtccagatgattatttccaggagaatccgattaccagcgacgttctaatgtctctgatccgagaaggtatgggccctggctacaccgtagccaacacatcctgtatcgcaaaacagttgtttaaatcgctaatctacattaatgaaaatacgaaaatattggaagtggaagtctccttagatcccgcgcagcgacacggcaactccgttcattttcaatcactacaacacattctatacaacgggctttgcctgatctcaccgatcaccaccctaagacggtactatcaaccaatcccatttcatcgattcttctccgacccgggaatctgcggcaccatgaatgctgatatccaagttttcctaaatacatttcctcactgtcaaagaaacgacggcggttttcctctcccgcccccattagcattagaattttataattggcaacgaacaccgttttccgtgtactcagccttctgccccaattccctgttgagcattatgacgcttgccgccatgcactcaaaattgtctcccgttgccatagcgatccaaagcaaaaacaaaatccatccgggctttgcggccacactagtccggacggataatttcgacgtcgagtgcctattatacagttccagagcagccacatctataattttagacgatcccacggtcaccgcggaagctaaagatatcgcaaccacttacaacttcacccagcacctaagttttgtagatatgggcttaggttttagctctaccaccgccactgccaatcttaagcgaattaaatcagatatggggagcaagatacaaaaccttttctccgccttcccgatacacgcgtttaccaacgcggacataaatacgtggattcgacatcacgtcgggatagaaaaacctaatccctccgagagcgaagcactaaacatcataacgttcggcggaattaacaaaaacccaccctccatactactgcatggtcaacaagctatctgcgaagttatactgaccccggttacgacaaacattaactttttcaaatcgccccacaacccaagaggcagggaatcatgtatgatgggaacggacccgcacaacgaagaggcggctagaaaagcattgtacgaccacacccaaacagacagcgatacattcgccgcaaccacaaacccttgggcatctctaccaggctccttaggcgatattctatacaacacggcacacagagaacaactatgttacaaccccaagacatacagtcccaacgctcaattttttaccgaatctgacatcttaaaaacaaacaagatgatgtacaaagtgataagcgaatactgcatgaaatcgaactcgtgtttaaacagcgatagcgaaatacaatactcgtgctctgagggcacggatagcttcgtaagcagaccatgccagttcttacaaaacgctctgcctcttcactgttcatccaaccaagctctattagagagtcggtctaaaaccggcaatacgcagatcagcgaaacccattattgtaattacgccataggagaaaccatacctttccaactcattatcgaatcatccatataaaatggaaaccgtctactgcactttcgatcacaaactgtcactttccgatatcagcaccctatgcaagctcatgaacatcgtcataccgatcccagctcaccaccatctaataggtagcggcaatttaggtctttatcccatcgtctcctccaacaaagattacgtccacgtccgaaacgtattacggaccatggtcgtaaccattctgcaaaaggtggaaggcaatcaactggttttgagaaagccggtgaccggccatcagtatgccataaagaacacaggacccttcccctgggaaaagggtgacaccttgacattgattccacctttatcgacgcactcggaagaaaagctattgaaactaggtgattgggagctcactgtacctttagtcgttccgacagccattgcggccgagatcaacatcagattgctatgcattggtcttatagcagttcacagagaatacaatgagatgcaaacaatcatcgatgagttatgctctatccaatacagagacgtactcattaaattaccagacatagtcaacgacaaacaatcaatgtactccatgaaaacagcttgcatctcgctgtccatgatcacggccatggccccagacatcgtgagaacttacatagatcggctaacgctggaagaccattcaatgcttttgatcaaatgccaagaactattatctaaaagaacaacgttaaacacacagcgctgcggacaacttcacgctacggaaattaaagatgaattaaaaaaagtcaaatcagtcttaactatgatcgaccaaattaattctttgaccaacgagaaaacgtattttgttgtctgtgacgtttccgcagataacagaatggctacatgtatttataaaaattaaatgctttttaaaaaaacactagcctactatgacttttctatcactcatacacaggattataaaaacacaccccgccgggacacccgcgtcctccatccgtcatacaaaatgacctcatcccttaaaaaaacacagtatttaaaaagggagatgaaacataaaatgttttttgtaccagcatgttttctcctcaactaaaccatgtcttgcaactcgtttttgattgcaatcacatagtttcgaattcttaccaagaaatcattttgaaatgtcgaatctcaagcacaaaaccaggaatcctattcataacagatggcactgaatcggaaactgaggacgttctgttcgatgtacagtttctcgaaaaaacaacgactatcaaaataaaaattttacctatttctaggacggttcccgtacggattcatttattttccatacccatttatctgccgtcacatgcactggagattgacgacatcaatgcgctatgtcaaaaagaaaacatcgatccgaccgtatacgaacaatatggcctaaccaatatgcctatctcgacaaccaacgtgataaatcaatttaaagtagttcagaatgatagcgttgaaatgtctttgatcttatttaacctaaactggacagaaagtccttatcagtctcaaaaattagaccgctatggcagaaagctgctaatagtttttagcgtgttcagcatcgataccagagaatgtccctattgggaaaacctattcaaaagtatcatcccactctgcagagtcaacatgatttccgaacccggcatctctatctacaaaatagaatttaacgatccttttctcacagtctttttgcgtaacgtagtgttgccggaaaacaagcgacggtttccaatcacgaaagaatgttatcttcgcttgaccttttccccccctgatcggagcaccgtcacgctaaatatgaatatgccgtattttaaaatctgcgcagacgggaagaatctagaggttttctttcccaacgatatgtccttagtaagtaatacaaacaaagagatcacgctacgcggcgagttcactaacaaaaaaatcgtaggcatcttcatccctgtccagacgcatgtcttcaagctgtatccatttttatggtttgcccaagaaccgttaaaattgcggatttcgtgcgaaagaacagtttccgtaaccgaacacgacatgttagggcgtgtcttttttgtgacgaagaagttgtttagaaagccgtttcgttcactctcaaacagcgacatgaaatctcttttaacacacacggagaataccgataaaccattcgacgtacacttcatgggcaattgttttcctgcatacttgctaccggaactcacattacatcccttagaatacgaagacaagcctgcgcgtggaaacccgcagactctcccgtccgtggaaaaacactctattataaaaatacgcatatgactctctacgtttacatcaactatttaacatccaaaatacactaacaggattcccttcagacatccagaaaagcaaacatgcaacccgccactctacaatggtcttcgtacgtactacagctaagagtaacaactaccgccatattaaaacccggcgaactgagattgtttaaatgcggattaggtatcacccccccttcatccgccgtagtgtgcatttgtagagacgaaagcagttttacatcatcgccttttacttacatcgatccaaaagattacggcaacatacccttcgcggtgcagaacatctcagatctagatctggatctcagtagattacctatcgtccttaatatatttgcacttcctcacgcaaacgtgaatatatcaaatttaccggtgcaacgcatcgaagcccacgatcgccacattataccccacggacagtgcgacgcgaagtttgtcatatatggccctctcacgcgtattaaaattcaagtggctgatatacgatggatagaacaaacaccagaagagccaacacgatattcatttaaggcagagatatgggttaatctccaaaacactccgctcgaccaaatttttaaaactggtaacatcgaatttatatcacacaaaaacgtctatatttctagaatcttactctgcggaaatctattaattttgaaggcaaactacgaaaacgactatctccttgacgataatttttatcctgaacaacttgccatacaaatttcactgaccccccaaaccgcagacattacattgtcgcagaatcaagaaacacttctaaaatgcaacacccattcaataactgtctgcgcaactaaaaatatcatccctaacacggttactcctgtccattgttcttttaacactatctttaattcaaattcaaactttacgggtttatttatacccaaactcttgctcggaatctctacaaccaccggcatttgggatgagacacggcctctctacatcaccatgaaagcatttaagaagaaccgtcgcatcaattactcgcaacctataggcgtagtatacttcttccccaaacaaattttaccaccggggaataatgtcgaattcaactggacagaagcaagcaaaatttatgtaaacacagaatctccaaatggtcccgtaagaaacaccgtaactttcacaaaccaagcagtattgcgaacaccaagtctaagcacggttgcaaacttaacgccagacatcaacatgggaatttttttgagttcactccgcgttgcgttcgacaccgcacatatggtacccttgcacttttctctaaaacccggagaatctactcgcatggaattcatgccgcctggaaccccacaaaacctaacgatattagaaggagatgtcggcattcatttcattccttgtcacaatcactcccatagatcttccccgtaactagcgcctaaataccattttatacgaaaataaaaaaaacaaaaaacaacttttaaccattcgttttattgaacgcgtcggtaaacaattatgtgtcaagtttcaccatgtccaggaattcactctgaatcttccttataacacacagctaaacaccacttgatcacaacataaaaatacattttaactatccattttatttaacgcgtcaacaaacaatttcttgttgagtttcagcagatccgtggattcgttctgaccagcaaggctcctatttacggtttcaggcgccaaagaagcgtttaaaatagatggctttggggacgcggcgcctttctcctcgatcgtaggcagagtctccatcggaacgatatgtctctgcggcgattgagcgcgaacatgcttcaacgcactaatctcttgtcttaacattcctatcatatccaccaattctctcaaatcgttcttttctcgagccatctccttatcgtcgtcgttgtcaactctatggcgcctccttttttttgtgtattccggatctcccgggaaacttaattcatcttccgaatcactctggaaatgccgctttttaagcgttttcgattgacgataaccgtgtaacgcggccggatactggggaacgggggaatattgccaatagggatacattgcctgacaaggactgtgatatcgattcgactcatgttctgcaatcttagcagccgactcagaatacggtagcatttgatactgttcagttacgggcggatgaacagaaacaggcggaactattttcggttgctgtccggttgtaacatttaaaagagaaaaaaaagcgtctttcggtaaaaaaacacaatccgaaaatggtggactcgacagcaaaggagtagtatttggcaaattttgattactcatagccgttgtagctgtcgcagactcaacggcgtcgtaattcccgtgcacaacaggcacgtcacacgtctcaaccgctaattcagacccaggttccgtagttaactgaacttgatcaccggcaactttggtcgctgcgacaataatctccacgggtggttcactagctttaatatacgtacatttagacaaaccacatagctgtttatccaactgcaactttggaaaccgttttctaatataagatgtatccaaactatccgcgagcaagtcatataaatccgccgaaaataaattttcatcgaaaccctgagaataaacattgaccccctccaaaacctgtctcttctcactctcactaatgcatgaaaacctatctagaatccagcttatttctcgcccgaaaatcgctatagttcccggtctccgaccgactccacatacagacacatgatgaaaaaacggtttaccgtctaaattttcatcctgcaaaactttgctagacagcgatagaccaggaaaacttgaacttaaacactcaatctccgggtccggtggtaaaggttcaattaccgagcctgctgtgattaactttgacttgccggcaatatttcttatgatgtccatgaacgtttgagactgtatctgcgcaacgcagaaaagcccatgctctaaatcgaaaagaccgcgtaccattccaatagtggccttttcgttgtgattaatattcaacggtaaaggaatatttccggaccccagttctttttgaaccgtgtccctgggcagagctaaacattcttccgacggttcttcaccataaacacaaaggaatccacctacccaaactttagacattttgagatgacccagataggacagtacataaaattgaacgacgccgtccctaatttaatattacacataaccacaaaactgcttagaaacgagaatctgactagctttaaacaagaggaattacttttaattcaacacgtatgtacatcaatgctgtcacacggaatcaagatcttactactacgcgaaagtttgtacaattctggaatcggagacatagtgattttgaatcgtaaaatcagcaacaactactggtttcgaatattttctattctgaaacagcattctgacgcggaactactccgacatatgtttaacgaaagtcactcagcatatatctcaaaaaagctgcactacagcggaaatgttagtcacatgattaattttcttttcatggacgagtttggtgtaaatctcaaaattccggaagaattaatctgcgaaggcaatatagttttctccgttggagctatctataatcaccgacttttaaaaatctgcagattctttaaccgattttggggggatcaagaacgagaaccaacagtgcggctcatctgcaaacacctatggtttgcctatcttataatgtttggaaaatttgagatatccacactggcgtacagtcagcaaagagccgagcacaaagccggactgttttcatttctccaaaacgactttaaagtcttctgcggtatgtctgaaaatccacaattactcgacagctctgccatatttgaccttacaggaatcagcgccgaagatctattctcttatgaataaaaacgataaactccttactcattttaacatttttattccaacctctaaatccgactccttttcgcgccgcgtacacgaaaaacatttcttacacaaattgaccagccagatactacacaaacgaacgggcacagtgtgatcatcacatgccatgcaataggccataacgggtatataataaacttttaaaacaggaagcgccataaaaatatcgcgcaaaccataaaaaatcttgtcactctcgatttcacttaagccagctttcggcagatgcgctattgtacctagcagcaaataaatacagagatacgtagtcacggtcgaaagttcatctttcaaaagcatgaaatttttgctgtatatgtaaataaacaccagcataactggaatcatgaccgaataaaccaacattaaccacatgtcgtatccgctccttaagaacgcgagaaaacactgtggggtctcgttctgcaaagctgttgctttgtaattattcagcatctgaagagcttgcactcccgatatgatccaaactatcgggaaacacacctttgccagagccttggaattctcgttcaacaacggtgtgctgtaacagaagtggttgatgcgctcgatcgccataaacaccaatgaccacgaggagaaatagatagaaaaatcatcgatgtagagaagaattgcgcaaaaatctcgcggcaaagaccaatgtccactcaacaatcccatctttatcggaagtaaaaaacaattaaagctcatcccggcaaatgtaaacacagcgtattctcgaccgactttaaaactattaaacctaaccgtcagtaaaaccattgtacacaactgtatggacgaaaaaataaatacccaaccataaaactccgcagtggctggccaagccaaagacttcgtttctttctccatcctgaataaacgaagtaatgattctttaaaagctctgtaagtctttatatccaaaaccccatccgtattgacgtaatcaacacaacatcccgccttatataacggccggtattggcagaaaacccaaaactagaaaatagatgaaatcataagtatcatttacattaaataatgaagaagccattgcaaacaatctctgtctcggtaatgtaaaagatagagtgatgtttaaaccgttttcaagatgaaagagaatgcagtcatgcttttcaagtatcgccacatccgcttgttgttccatttgagcgcggatatactccacgaacggattttccttagattgaacctgaacggcatcggacggagcccccgcacacttatgttcccatcccaatctcacactctcatttacacacacggccacgagaccgggaaaaagagtcgaaattgatatgtcattctgcaggttgtacataggcacaacgtaatggtgcattaagtattcaaaattttgaatgtttccagcttcaaagttattttcggcgaaatcgacattctccaactgtggaaaaatcgaagttaagagaaacttcccaactctcttgttaaacaaactttctgagttcaggatccgccacaataaaaaaagactttcaattgcaaccaagccagaccgtaaataatgttgatcgtgtatgaagattggaacattatttcccaattttggcctcattagctgatatgtccaatacaccaaaacatcattcttaatggccccgtgtaaacgagcttcaacatcaaaattttggctaattttctcaccgggaattttttgcattacccctctacctagcaacatctttataagcacatgattcccgaatgtgttttctgcataatgcttgccttttctcatgggaacaaaaaatttcatacaagaaggatcattaaatccaaaataggtgccagaaggagagacatttttcaatgctgtaatttcactgccgagtaatctgaatatcacaggcaggagggttataacatctactagggttgtacgttcgtcgatctgtgaattctcataagtggaataaaaagctgccaggatacacaaggctgcttccaggtctgacatttcacttccgaatataggatacaccgtcgcttgctccaacgcattgacggtaactgctagtaactcttttgaaatagtcagagaatccacattagtaagttttaaagcccttcttaaaccgggctcattgtaaaaaaccctcttgagcttatagaaccaagacccgaacgtaaaattccacatctgggcattattgaaaaatgtattgatcatttctcctctaaaatcgtctgtaaatcttataaaggggtcgagtggggttatagcgacctgattgaatttttccagcttctcaggagatttcggtatcagttgcgcatcagctttcgtttcgacgtttacctccccatcattcgtaaacagcaaagcatcctctatcgctttcaaatgagaattcaaaacgtcactgtctttttgcatctttttttgcagtgcgtctaattcggtttttaggcgcattcttagcaacttgtcgcgatgcccttgatctattttctcccgaagtcttagtgaggactgactttggagcttttcgacatctttttctgtacaaatcagtatgtttctgacatgcccttctaaaattggtgtaattgggtattgataaaagagattgcactgcgccatcctgagacctggcgaacaaatcacgtataaacgaaaatgacaaccgcttggtcttccccgaaaactttttaaaaaaatctaacttgagtccccactgcctgaaaaaacagattacgggaacaacgttccacgaaacctcgtctgcgattaaatattgatccaagaacgaaatagactgttgcaactgtctcaaaccttgcaaatattgcgcctggtgaatgcagttgtgatgcacagactgcatcgtcgacttccccaaagtcgtcttaaactcgaaaaaataacaatgaaaagcaaactcatctttggcatctacactctttagcaagacgatacaatccggaatgcgcggccctagacgcacctcgaaaaacaccgagacagatgccgatcgcaaattagccggaaacacgtctcctaaaaaataatttagtcgcgcaaaatttccttgtaaagataagatctgtttatatatcctcaagtggtgaaactgtccaatttttttccggatatcaggcaaacctgtcagagacatgttatttcacgggaaaaaaaagacacggagaatttagaaacaattccgagttccattacacatcatttttgtaatctatttaatatggaaagatcaaaaagtgttcaactttcaaagaatagcagaaccgtttcacacttcatcgatgaagaacaactatgctcctccgactctgggtctttgtcctgttgactccctgttacggttggagaccgttgaacatatcgaactcgagccattgtagaaatggaaactttgaaaatccaatcgttcgccccggctttataacatttaacttttatacaaaaaacgacactcggatatatcaagtccctaaatgcttactcggctccgatatcacataccacctgtttgatgccatcaacacgacagaatcgttaacaaattatgaaaaacgcgttacacgtttttatgagccgccaatgaacgatattttaagactttctcctgtaccttcggtcaaacaatttaacttagatcgctctatccaaccgcaggttgtgtattccttaaacatgtacccttcacagggaatttattacgtcagggtcgtagaagttcgacagatgcaatacgacaacgtttcctgtaagctgcctaattctctcaaggaactaatatttccagtccaagtcagatgcgctaaaattacgcgctatgtgggcgaagacatctatacccatttctttactccggactttatgatactgtacatccagaatcccgcgggagatctgactatgatgtacggaaacaccaccagcataaactttaaagccccttataagaaaagttcattcatattcaaacagacattgacagacgatttactattgatagtcgaaaaagacgtaatagatgtacaataccgtttcatatcagatgcgacattcgtagacgaaacgttgaatgacgtagatgaagtagaagctctactactcaaatttaataacctaggaatccaaaccctattaagaggagactgtaaaaaacccaactatgccggcataccgcagatgatgtttctttacggtatcgtacatttctcatatagcacaaaaaacacaggaccaatgcccgtgttaagagtgttaaagacacacgaaaatctcctgtccatcgactcatttgtcaaccgatgtgtgaacgtatcggaaggtacgttacaatacccaaaaatgaaggaatttttaaaatacgagccctcggactatagctacataaccaaaaacaaatccatttccgtatctacgctgctcacgtacttagcgacagcgtacgaatccaatgtaacgatttccaagtacaagtggactgacattgccaacactctacaaaacatctatgaaaaacacatgttttttactaatctgacattttccgatagggaaactctattcatgctagccgaaatagcgaatatcatccctaccgatgaacgcatgcagaggcacatgcaactactaattggaaacctgtgtaaccccgtagaaatagtttcatgggcccgcatgcttacagctgacagggcaccgaatctagaaaatatttattcgccttgtgcctcccccgtacgcagagatgtgacaaattcttttctaaaaacagttctcacgtacgcttcccttgaccgttatcgatcagacatgatggagatgctatccgtatacagaccgccaaatatggagagagtagcggctattcagtgtctctccccaagtgaaccagcagcttctctgactctgccgaatgtgacatttgtaatttctccctcttacgtgattaaaggagtgagcctaacaattacaacgacaattgtggctacgagtataataatcacagccatacctctcaattccacctgcgtttcaaccaactataaatatgcaggacaagatctgcttgtgctacgaaacatctcatctcaaacatgcgagttctgtcagagcgtagtcatggaatatgatgatatcgacggtcccttacaatacatttacataaaaaacatagacgaactaaaaacattgacagatcccaacaacaatttacttgttcccaacaccaggacgcactatcttttgttagccaaaaacggctctgtttttgagatgtctgaagtcggaatcgatatagaccaagtgtctatcatattggttatcatttatattctgatcgcaataattgctttattcggattatatagacttatcagattgtgttgaataaacgttttatttatgttaggtattagatgaatttgtccgtatacagctaaacgccgacaacgtgctcgtataaatatcgccattaaatccgattatcgcccggtaaattactagtaataacattaaaatagccagggcattcgtaatcgcggtccaacacagcatgcatttggaggtcatcgtccaatcctataaaaaaagcaaatactattttagtcacacattctacttgtacaaattcattgtggtcaactcacccgacatgcttcacatctcgcgactcggcctttttctgggccttttcgcgatagtcatgcactccgttaatctaataaaatacacgtctgatcccttagaagctttcaaaaccgtcaaccgccacaattggagcgacgaacaaagagaacatttttacgacctccgaaacttatatacaagtttttgtcagacaaatctatccctcgactgcttcactcaaattttaactaacgttttctcttgggacattcgagattcacaatgcaagtctgcggttagcttgtctccattacagaatttaccgcggacagaaatcaaaatagtgctatcctcgacgactgcaaacaaatctatcatcgctagcagtttttctctattttatcttctgtttgccacactatctacatataccgcagatccgccatgcgtagagttactaccatttaaaattctgggagcacagttatttgacataaaactaaccgaagaatccttgcggatggcaatgagcaaattttccaactcgaatctgacacggtcattgacttccttcacgtcaaaaaacttctttaattacaccagctttgtttacttcttgctctataacacaacatcatgcgtcccttcaaatgatcaatatttcaaacagtcgccaaaacctataaatgttaccacttcctttggacgagccatcgtaaactttgattcgatactaactactacaccatcatcgacgtcagcgtctctcacatcaccacatatccctagtaccaacataccaaccccagcacctccccccgtaacaaaaaactctacaaaactgcatacagacaccataaaagttacaccgaacacacccactataacaacgcaaacaacggaaagcatcaaaaaaatagttaaacgttcagattttcctcgacccatgtacaccccaaccgacattccaactcttacaatccgtcttaacgccactattaaaaccgaacaaaacaccgaaaacccaaaaagtccaccaaaaccaacaaattttgaaaataccacaatcagaattcccaaaacccttgagagcgctacagcaacaacaaacgcaacccaaaagatcgaaagcaccaccttcacaacaataggaatcaaggaaattaacggcaatacctattcttcaccaaaaaactctatttatcttaagagcaaatcacagcagagtacaacaaaattcaccgacgccgaacacaccactccgattttaaagtttaccacttggcaaaacacggtacgcacatacatgagtcacaacacagaagtacaaaacatgaccgacaaattccagaggacaaccttgaaatcctcaaacgagctacctaccattcagacgttgtctgtcactccaaaacaaaaactaccgtcgaatgtaactgccaaaactgaagtacacataactaacaacgctttaccatctagtaattcatcatactcaatcactgaagtcactaaagaggtaaagcatactagaatgtcagcgtccactcacgaacagataaaccacacagaaatagcacaaataacaccaattcttaacgctcacacatcggaaaaatcaactacacctcaacggtccttcaccgctgaaacgttcttaacgacatcttcaaagcctaacatcataacctggtcaaacttactaacaacaacgcctaaggaaccattaacgaatacaagtctaaggtggacagatcatatcacaacacagctaacgactagcaatagaactcaatcagccaaactaacaaaagctaacatctcgtcacaaacgactaacatctacccccaaacaatcacgggacgatctacagaggtttaaaaaagttctacaaaaagtcgggaggctaacgcaactctacctggaaacaacgactaccacatcaccgataaaaactcacacaaccatccagataacctcactactgaaaccaaagcatactcaacccaaaatgcaacgcatcacacatacaacgaacgacgcgatttaaacaacacagcacataactgcatacgtttgccaaagctgctcatcttcagtcttcaataaaaactcaattttgaaatgagttttgtcttttgtcgttataaaatctattgaagataataaaacaagatccaatcacaacaaaaatgcttttatttgtcgtatgctacatttataattaaaatagaagtctcacgcgatctaataacccttcaccgtctctgaagcaaaagtcttataacaccagtatttcaagaaaatcgcgaaagaacataacaataaaaaaagatttatcaaaagccagatcgaagaaaatgaattcaagacgatctcataggtatgcgaatggcactctggagaataaaagtccacttccgtagcggccgcaaaaacaagaatgtaaaagaggcagagactgacatataagctttgccttgcgcttttcttacaactcatcttaagcgttattttcaactagtcttcgcgtcgacgtgattaacagcagacagctctctgtcacctggaaaaatgtacagcgcaatttcagaaaagatctccgaaacgattaccctacagagacaaacgagctcgagatacattgaatttttcgtctttcgaaatgtggacatcaatgaactttggactacagacatatctgaagacaaaacgcacgacgtgtggccggctgtaaatgagaaatcatttaaaaaatttctagaaaacgaactaacctcttatcaacgcccaatcccgcttctaggtattccgcaaaatggaacagtgtcgaagacctgcaaaaaagagaagcaaagagaaaccgattgtgttaactatgaaaggaaacgcggcaacccagtaactttctacccaaggcaccgcgcaaaaagaaatgcaaatacggacacttgtatttcggaagaaccatctattttagtaagccatcacaggaatagtaaaatggacgtttttatggacaccaacaaaatcacactcgtaaatagagaactcatatgggtgccgcacgatcaagttcgaatcgtaaaactagatatttccctgtacatcccagatggtttcttcggagttattactggccacagcaacgacgtattctgcgaatgcgtcactgaaataataaccgacgaaaccgacatttcagtttttctaatgaacttatccgagcactctctaatgcttctcccaggagatgtggaattctcaatcaactttctcccttgctacatcccggaaccatgggagatgatcaatctgtctccccccgaatttgcaattttccatctaaaagcatccagagaatttatagctaaaccgaacagctatacgatacaatacttcgacgccatgtacgtttgcgccgatgaactgaaggctctcatgattccctcaaaagaaattgccaaactcggcttattgatcgaaacctacatctggaacaaagatacaattccctccataaagatcttcaactccacacgcaaaactatctacatccctacaggcatctgcatcgccaggataatttttacttgcggacatttttgcctcagtttaatgcctgaacgtgcaataaaccggctacaggtactagacgccaattcctctttcttgtttcattatgccgcctccaataacgcttaactatacactctcaccttcagactcaacgcgtatcgatttaaccttttcacttggagcttccgtcacaacatttggcagcgcttgatataatcccgtctcctcatggagaatcggatccaactcgactaaaagacgtttgctgttttcaccatcaatctctatgagactgtttattttctcgacatcgctaagtgttgactgatctgtagcgaatttgttaagcaactgattaagattttcggtgcacatggaaaattcgccaattaaagttttcataaaaacgacatccatcgtttgtaatattttttcagctttcataagctctacacagagcgcatctttaacatggttaggacaattagataaacaacgctccataaccgtatgcctgagcttagtttttttgtacattggtaataagcctaacagagttttcatagtttccgtgtctttttgatgacttataatatcattctgataaactccaaaatctttatacgtcatatccagaaaaaacgtcagctcttcggtctctaaatcgtcggaagagcacaacatttcatactttgcctgagtcggctgtccaaacaaagataatcgtcgaaaacaatttcccataacaccccaataccccaaggacatttaaagctaaattcatctgtaatcaacagagctctacacaatgaccatcgtagtgtttgcgactgaatacgatgccgccaacgtaatttttagtatcctatgtagaagtcccagtgaacatttaatctttccgattattgttaaatataaaccatcaaataacgttagtttctgccttcaaactcaaaaatgcaaaaattcaaagcgaatcgacacggtatttgtctgccatgccgaaaaattaaatctcagccactacatacaaactgcaagtccgataaaggctgaagatgtcgccaacagcctcaacgacaaagaaaccgaatcgttatatgtcgacatgatattatctcaaactggaaaagaaagagaggacgtcgaatttaaatacatggcctatttccacaaatcgctcattatcaaatatctcaccggtaaattcctattgcccacttcccccttttggtttttatcgacctacgggcaaacagaaggtatgcttttattaacaatgttttactatttgttcgaggaacaaaagagtaccatcacgactaccaaaaattatgttcaatgcttcacggaaaacaccggaaacatggtgttcacgtattcttccatgtccgaatttataaacatcactttaaaatcaaaatttagaaaactatttgcagacttctcaacgtacgccagacaaaaaaatcttcgcgataaggaagaatttaaacatctagacactcaaatcaatctatttagaaagagttcacatctaaccaacacattccgtgtccattacatatatatcgcttacaacacggccctagagacaacaaaattcgtcaattactgcaatctcacttcttacgactctaatttaccaatagggcaacaatgtcagagaaatctccacattcttggaaattccctgcacgaaaatttactgtgtatcatgaagcaatactttaatgcggattgttactttaaaacatacatagacataaaaagattaaaaaatccaaatctaaacgttacagaatacgagtatgctctggtctctaaaaagaagaccatccaagcattaacttccgaacaaataacgcgtgccatagcgaaatgtaataaaaacggagaaggtcttttttctccagtaaaaccaggattacaaggattattagaaatctccgcttccgatagatacgttcagatacaagataagcgcatctacagaagacaacacctacacaaagattatcaccgtccctttcctgtattcagggtgcagcttttacataaaaatattttttgcttcggaaactctgaggattggtacgaaaacatgggatttaaccgcatcttacagtatctccccgacgaatatatctctgatgaagctctaactcgcgccatctggctgcaagacacacattttctctgcgacgacgtcgaaaaacaattctataccacacgacacgaaatattcaacgaacgcataccagtcacaaattacataggagacttggatcttccgctgcaagatacagcaactattacggaggaaacatttttctcgatgtgtcgcctcataagacttaccctcatcaacgcctggaaaaaaatttttccaagcatcgacacagacacacatcccatcttcttcttcaaaacccagtgcgacacaactaacgacacactagactatactgaagatccaaccgaaatcaaacaattctgtgtttgtcggaaaaagatcggtcttagaatatcaatcccattacctaatggcacagcgattgccggtggagaaccattaaaacaattatccaagattttaaatcacgttatgtgcttagatcaggagcttagtcagatcctcaattccataacatttcccggggaatgtttcgacatcggcatttaccacacaggtcactgcatcagaataggttatatgtacaagacagacatggacaaagggaaaatgctacatggacgtctaactcccatatttatcgtcccagaaggttaccgaaattcttgcaagacatttattcagatgcaaatggatttaaacaaccttctacatcacggtactaagaaggctcccatcgaagaattaatctataacataacggataaaggctgccctaaagaaaacctaagtttcatggatttaaaatccagacaactgtggaacaaagttaacatagctacagagactctaatcaccaagtacctaaacacgcatggttttaacaacaatgcaacatcagcggatgactcccttttatcgtttatcagattaataggatggccaatcattaaaacgcaactaattactcattacgagactaggatagcgcaacagttttcacaagtaacttttattaaaatagattcaaagaacctccagatcaaaaaaacacaatttggaagagtttcggattttagctgcctgaacagacaacatagaggaaatcgagataacgtcctagtttacatacaactcaaagccgacggaaatcggttaattctcatcttgtggagcacgtgctttgctactaaatgccagtccaacagcaaacaagtacattgttccatcgccttggagcaattgaaaaactaacttactacctctaaacccagaccttcttttagtctttaccatttgactccaacgcacacgctaactaaatcgcgccatatcctagcatttccggagattaaaacatcagtaacaccgtccttccttttttcgcaaaacttaaccgcaaaaaagcgccaacgaaaagcatctcaaaaaacatataaagagaccaatttatgtcatttcatctattataagcaaacatgtatcctcgtggagtaaaacgctcacatcatgattatcatagacaaaccgcctttagaacgataaaacgttccacgcatagacaaaccagcaagttcatcagccatttcgccaaaaattttcgaggaaaactcgcacctctgaaacactgtgaatccagactagacgcactaagtctgacagagttagaacagctgaagaccatcatcgaagagaaacaacaagaaaaacgcgctcaaaacaatgcgatcacctttctgcctaatcttccaacagtcccctttgccgacacaaacttttcgctaaaatctctcggcctgagaccttacaacggagacgcccgtgatccaaaacaacgcatccgagacagattcccacagactcacgaacgaatttgtctcctgactaatgatatactggaaaccgacctgctgcttcgctaccgacaatgtctagactcgctcacacgagaagaaaatcagcaactgatgggcgaccggatattctccctgaccaactcaccttgtcttgcttttacagttgctacagtagaagaagcctgcagttattttaaatttcacgatcttcacaacctgccggtcaacccacaagacttattcatgtataccatcaccgtcatgaaattcgaatttttcaacaaactcaacatggcaaagttaacctgtgtttttaacgacaacggacacggtgacatcgaataccgaaaactcaggcaactctgcggtaaacctgtactagatcgagagatgccaaactccgagcttgaagtacaacaacaaactccagactcgtttagacacccaattcaacaagccatgtccatcgttgttacgtttgctcgaatactacgacaaatcaaagagcaaatcatacaaacaaagaagccgcaattcatccgcgatttcgacacaggacgggtagccgagcgatacgaatgcggtctgatgagcagactcatcggaaaacaattcagtaaccataaatgcgatgatgtcagctgtcagaatagaatcgaacgaatcatggctccttggaaaccgagtctatttttttgcacttatttcgccaaagacgcaccaaagtttaagctatttccaaattttcctgaagaataccgaaatctttcttttacttgtccaaaggtcgacacggaaccttcatgtagctattcaacaaatcacgacctacctcagacctctcatcgttcacataaaaaccacggtacgcctaaagtcaagtccaaagtttgtgtcgaaaaaccggacacttcaatcctaacaacgacaaaaacaactaccgaaattctcatagaagaatcaatggaaaccgacaacaaaataccaaatcctagagaactaaacttcaatcaagcaaaacaagaagaaattgtgattattaacattaatgaaaacgtcaactctaaacatgaaagtgaatcgagtgttgaaatggacttagatttagactatgaagctgacacctgtgaaactaacttaaacgcatgttcttctgactcagaataactatcttaccgtaaacaaattcttacattttgtacaaactttttgccgtcacactcttaactacttctttctaaaatcaaaaaaattttgatgccaaagctttatgtaccctaagtgaaattcaaaataaatactagctaaaacttgaaagcctgttttagtctatccatgaaactctttgaacttttttcggattttgaatttaccgtttaaactatgcaaacgaaaccatcgtcataacctcatcgcgactaaaaatacggaaaaagtatcctaaataccaattccttaattctaaatacgatattaacgacttcgacttcaaacacctcacaatctaatacatataaaagctaaatcaaatgattttacaaagacctatatttttaccgaaccataatctaaaattgaaacgctgaatacattcactgataatcacaaagcaaacctcgcagaacttgccctaaaaacgtgaatttaacagcatgctttatcatgtacccgatttaaaatttaatttcaaaaaataccgtgaaaactactgtatttaatgttttgtcactttgtgaattctacgttttaaaatgcttaaattacatgtgtaatctaataatatgctttatcatttacccgatttaaactttttgaatttcgaaaaaacatcactaaaactactgtattcgtaaatgttttcacgttgtgagttatacgttttaaaatgcttaaattacatgtggaagtaaatgttaaaattataccgaaaacctcaaaaaaacttgctttgttaacgtgaagaatctaataatatgctttatcatttacccgatttaaaattttttaatttcgaaaaatatcacgaaaactactgtattcgtaaatatgttttcacgttgtgagttatacgttttaaaatgcttaaattacatatggaattaatttttgaaattccgctgaaaagtttactgtcgccggcgaattaatttttttgcagaaaatagcacacgaagaatcattttcaatcaaacgtatcaagccgtaccccagcgtccctctgaacagtcggccgctcgcagccttcttaaatcctgttctgagaatgcataattaggctatgacgtaaacgccacgccctcgttctcccgtcctcaataagtttattaaaataatatatatataatatactattgtacctgaggtggacgacgatttgcataaatttaaattaaggggcgtgtcatatcatctgcgtggaaaatatttgcataaaaaaatcgtttttcttttgaccgtaaacctcatatagaaaacggtataattcaacttgtggtttactcttatgtttgatgacgcgtgttatgttacgtcaaacataatatataaggatttcaccacaaaaccccattatctctgtttctgtgatcaaatccacaaagatggctgatgaaaacgaaacggtagtttctgctcccgtttctactgctgcttggatctatgttttcccaaaagataaagaacttttggatgttttatctgttttatcgttaatggagagaaattctcctatagttatttcgccgttgttaatgaatttgaccgtagaaaacgatttctcgaccacggttaaaacacctatcactaattttggaggcacaattctaactaaaattacgtcttttatgcccgtgtgttttttttttcatggaactgagcagttagttggtatggccgaagatcatggtgatcttattcgattatgtgagcaaaccagacaaaaatttcacttgcaatcgtttgaggtgcctacagcacgcaaagtaatcgatatcaaagctctttgttctgctgtcggcaaagatgcagattctgttatttgtcatgttgcgtgtggaaacggtttcaaagagttgttgttcgctggtctgttaattccttgtgttgaagaacaaattcaagtacaagttggggagtattcgtgtgtgaaaattcctctatattccgcaactttatttgaaactgaagaaacgatttctttatcttcctgtacagaatttattcaggaacgaggattttttctgcctgcgttaagtgaaacgcttttttattatgtttttacatcatggggtacaacattacgattttctaatactaaggaattaatcgatgctggcctgaaacaatttacacaggatggggagcaaactgtcaaattagcaccccataaaacttatctgggtatctccggacagaaaatttcagcggtcgagaaagattttttgatgttggttgattccgttgtgacagaattatcgtttagtcatgtagccgaatatctggattcggtatatgaccctagtcagataatgaattttaatgactggccaatcataagaaactcagagacacacgctgaacgcatggcgcagctcacgaatttaaagttacatctgtctagtcatcttgctgttttgatctttgccccaaattctatcttatattgctcaaaattggcatttataccaaacgtgaaacaagcgtttaattcggtgatgactcaggaattactgctgagatctttgtctttttgtaatgcgttgtcgtctttgagtgacgatgtgtataacgataatagaaaaattatcaaatgtgattcgacatcaggcaaagatgacaaattttcagctaatcacttggcttatgcctgtgcgacttctccacagctgctttcttttgtggtgtggaatttaaatcgtatgagcgtttataacgcgggtaatgcgcatactgagatttacaatcatctggtaaattgttcggcgaatttatgtgaattctgtgatgggaaatgttgtcaatcgtgtattggaactgccatggtgcgggtcggtactcgtttaccggcaataccaaagaatgttaaaaaggaaccacttgttatgagcatgttttctcggtattatgccgaggttgatatattaggctcttttggcaggaagcctgtcagcgagctcaaagagattggaaaagatcaacaaaacacgctctcactggacaggggtaaattcgtatctcagatcttcgattactgtaaaaaaaattctctgattgatcctgtaacaggcgaagatactttcaatgttcgaagtaaaaaagattttgtttctataattcacggattaacacagtgtatcgaggaatgtgtttctagatgcattgttgaaatgagaaggacacaaacgcctagagaacagatagaaaattgtctacagtcatttaatgtagatacgaccccttatgcaactgccttttctccttttttgacgttttcatattataaggtcattttgacggttttgcagaacctcgcattgatagtggcttcaggtcatgttgtcgatagaccttgtaccggtaattcaatttctaaatggctcgttcagcagtaccagtcattatacggaacgtttcacagcagctatctcaaaaagggttttctgaatacgagaacagttaaagtcgcttcaaatgttgatatggagcaaatcttagattgcgatctatataaatcgggtaaatatgtgaaaactacgattcaggcgaaactttgccgtttgtctatgcaatgtcttcgagattttagaataaaaaatagaccgttcaacaagtctagtaagacagcacacaacaatccttattttaaaaaaaacgtgaaacataagaagaatcccttgtctggctgtatctcctttcttttatttaaatatcatgataaattgtttccgaatgtgaagatttcgtgcttagagctatggcaacgttttctgctcaacaatgttccgaaaactttagatattggtaaccccgaagaagttaaaacttttattaaatttgcattcagtattacgaatacctatgatgagatagatattatcgacatacagccagagtgtctctcaacttttatagattgttattttcataacaaatttttgtcggctttaggttttcatgactacttgactagtttacatggtcttacatctaagctggttacgcagaatcctgtgttgtttcctgtggtgttagacaagcagcctaaattttcttctattcaggaatatttagtttatgttaaaaagttagttttggatggcgttccgaatcctgtgattgcgtcactgtccaaagaacccaattttggtacaattttcacaagtcgatctttggttacatttggtttgacattagagaaatttgtgagtttggctaatagggaatattttcagtttggccagttaggttggataggcggaagtggcgtggataggaacttaaaccctacctcttctgcattgcaggattttagatttatgagacagaaaacgattattgctacaaagttttcagaagttatagtgaaaaaggttcggcgtgaggcaattatgtttgatacggaagtagttaagggcaaggttctcagcattgttgagaatttaactaacgatattgatccagaattattaataatagctgaggtgatgagggatagggaagacaagccgactatggatgatatgcttttttttgtggatggtagggaagccttagcggcatccataatgcttaaattgaatcacttagttgatatgaatgtgaaagacttttcaataactaatctgcagtcggtattcgagacggtgtcttcaaacgatgctccggtctatgacttttctgaaattctagcggaggaggacgatcaaggaaacggtgtattaaaatgtgatgaaacggaaaccgaaacagatgagccgatgactaagaaaaaccgattataatcggagtatgaattcgttacaatctctgtgtgtgttgtgcgctaggcttaatgaatgtgctttggaccttgaatgtttaaagttttgtgatcctgtaatagtattgtctgatatggcaaattttaaaaagaatgggattgtgattctgcatttatatcaaactttttttgaaggtatcaaagaacaaaatcttctttgtgcgtcagctttgacggtttatatgcaggtactgctaaaagctatgtatgaacaggtgcttcttttggatgcagcgttggaaagctttatggtagaccaggatagaaaaaaatattttgaaaaggtgttgtgtttgaggcgttgtgctgagaccttgtcaataaacatttcattgaataacggtgttgagtttatcgtgcaattatctacgctaaatgatatagaacaattaatcagtaagatcaactccgtatatgctttacttttgccccaagaagggttgcagatttgcggaaaaattatagacttgttaactatcatgtgtggtgcatgtatggttgcgaaaccggagagttatctcgaaactaagacttgcatgaagtgttacgaagaattgactttgactccaaaccaaggaaaatcacttcgaagaagattacatgggaagttttgtaatcatttgaccgaacaaaaagctttttttaatattgaaaaaaacattgagacgatagagaaagacttaggggaggctattttgaactatgggactgttcagtctgttgcgactgaaatcaaaaagatttttaagcagcagcgttcagccgagtcgttgcatgttagtgatgctgagaaaactctgaaaaagtataatatttttagcaaggtacctgacgtgatatattctttaagtgagtttacgtattggtctaaaatatcggaaacgatagtgagaaatgtcgctattacgcttcagcagttaaatagttgtcatacgttgtataagcaattacagaatgatgtcagtctttatctttacggtgaagtgtctgaagacttcttggctttgagtgaaaatttgttaacgcatgacgagcgcttgtacgttggctccatttatgtgtctccttcgaggctgatagatcttgtcactggcctgagcattaaaaatctcgaagaaagtccaatatttaaaagattggctgaggaagatgaggttcaacataaaattaagagtctcttgcatgacattcgggatccacagacgacagaaacaccgggaaggcttaacacgatcaattgcatgcttcaaactcataatcttcagcaggaagtcttggcccggaaaaaggcgtattttcaaaaggtttctgaatctggttataatagggtgatggcatgtattcgagagcaagaatcactcataaataaggtagtgagtgtgaatgtgtatgggaattttatttttgaggccttatcgaagattatgaacggtttcgttctcagaaaaatgtacttggatggctctttccgtgtagatagctgtacatacgatgaacatctttatattaaaaacaatctgatgccgaagaagctccctttggagctcttgccggatttaagtgagattatgtacacattgttaacgggtccgttatcggattttcataaatctgcctatccacttccggcgaacatctcaatggcgtatggttgcgaccacgcggagatgttaccgcatatgaaggaagatttagctagatgcatagagggcactattcatcctagtgtgtggatggtgtgcgaatacaatgaattttttaacttttccggtgtaactgatgtaaatgacatgcagaaaaaaatgtggaattttatcagagagttaacactttctgttgcactatataatgatgtttttggaaagcgattaaaaattgtgcgtatagatgaggagggggatttgagtggaaatgtcgttttgacatttaatcacgagtctcctttattatttcacactggtggtggcatgacaaagtttaaagacgtgtattcgctgttatattgtgatttgcaagctcagttgtcgagagagactgtagacgtgccggaaggagtaagttactctgttcgaacgcctaatctactagatctcgttagggaaaatgagcaagatggcagtattattcctggctgtctttttgatgaatagtgttttaatgatatattgtgatccggatcattatatcagagcgggctataatcacaaatatccttttcggatttgttcgattgccaaaggcacggatttaatgcggttcgacagagatatttcgtgctcgccgtataagtctaatgcaaagatgtcggagggttttttcatcatttacaaaacaaatatcgagacctacacttttccagtgagaacgtataaaaaagagttgacgttccaaagtagttaccgtgatgtgggtgtggtttattttctggatcggacggtgatgggtttggccatgccggtgtacgaagcaaatttagttaattctcatgcgcagtgttattccgccgtagcgatgaaacgacccgatggtacggtgtttagtgcctttcatgaggataataataaaaacaatactctaaatttatttcctctgaatttcaaatctataactaataaaagatttatcactacgaaagaaccctactttgcaaggggtcctttgtggctatattctacatcaacgtctctcaattgtattgtgacggaggctacggctaaggcgaaatacccgtttagttactttgctttgacgactggcgaaatcgtggaagggtctccgttcttcaacggttcaaacggtaaacattttgcagagccgttagaaaaattgacaatcttggaaaactatactatgatagaagatctaatgaatggtatgaatggggccactacgttagtgaggaaaatcgcttttctcgagaaagcggatactttgttttcttgggaaatcaaggaagagaatgaatcggtgtgtatgctaaagcactggaccacggtgactcacgggcttcgagcggagacgaatgagacctatcactttatctctaaggagttgacagccgctttcgtcgcccccaaggagtccttaaatcttaccgatccgaaacaaacgtgtattaagaatgaatttgaaaaaataattaatgaagtctatatgtcagattataatgatacatatagcatgaatggtagttatcaaatttttaagactacgggagatttgattttgatttggcaacctcttgtgcaaaaatctcttatgtttcttgagcagggttcggaaaaaatacgtaggaggcgagatgtgggggatgttaagtctagacatgatattctttatgtgcaattacagtatctttatgatactttgaaagattatatcaatgatgcattggggaatttggcagaatcttggtgtctcgatcaaaagcgaacgataacgatgttgcacgaacttagtaagattagtccgtcgagtatcgtgtctgaggtttacggtcgtccgatatctgcacagttgcatggtgacgtgttagctatctcgaaatgcatagaggttaatcagtcatccgttcagcttcataagagtatgcgggtcgtcgatgcaaagggagtaaggagtgaaacgatgtgttataatcggcccttggtgacgtttagttttgtgaactcgacgcctgaggttgtccctggccagctagggttagataatgaaattctgttgggtgatcataggacagaggaatgtgaaatacctagtacaaagatctttttatctggaaatcatgcgcacgtgtataccgattatacgcatacgaattcgacgcccatagaagacattgaggtattggatgcttttattagactaaaaatcgatcctcttgaaaatgccgattttaaagtactcgatttatattcgccggacgaattgagtagagcaaacgttttcgatctagagaatattcttcgtgaatataactcatataagagcgcactatatactatagaagctaaaattgctacgaatacaccttcgtatgttaatgggattaattcttttttacaagggcttggggctataggcactggattgggctcggttataagtgttacggcaggagcgcttggggatattgtgggtggagtggtgtcttttctaaaaaatccattcgggggtggtctcatgttgattttagcgatagtagttgttgtgataataattgtggttttcgttagacaaagacatgtgcttagtaagcctattgacatgatgtttccttatgccaccaatccggtgactactgtgtccagtgttacggggaccactgtcgtcaagacacctagtgttaaggatgttgacgggggcacatctgttgcggtttcggaaaaggaggagggtatggctgacgtcagtgggcaagtaagtgacgatgaatattcacaagaagatgctttaaaaatgctcaaggccataaagtccttagacgagtcctacagaagaaaaccttcgtcttctgagtctcatgcctcaaaacctagtttgatagacaggatcaggtatagaggttataagagtgtaaatgtagaagaagcgtgatggattcggtgtcgttttttaatccatatttggaagcgaatcgcttaaagaaaaaaagcagatcgagttacattcgtatacttcctcgcggtataatgcatgatggtgcggcgggattaataaaggatgtttgtgactctgaaccgcgtatgttttatcgagaccgacagtatttactgagcaaagaaatgacctggccgagtttggacatagctcggtccaaggattatgatcatatgaggatgaagtttcacatatatgatgctgtagaaacgttaatgtttacggattcgatcgagaatcttccttttcagtatagacattttgtgattccttcggggacagtgattagaatgtttgggagaactgaggacggtgagaagatctgcgtgaacgtgtttggacaggagcaatatttctactgcgaatgcgtcgacggaagaagcctgaaggctactataaacaatttgatgttaaccggcgaggttaaaatgtcgtgttcttttgtcattgagccggctgataagttgtcgttgtatgggtacaatgccaacactgtcgttaatctgtttaaagtgagttttggaaatttttatgtatctcaacgtattggaaagattctgcagaatgagggattcgtagtttatgaaatcgacgtagatgttttgactcgtttcttcgtcgataatggttttttgagtttcggatggtataatgtaaaaaaatatattcctcaagatatgggaaaagggagtaatcttgaggtggaaattaattgtcatgtctctgatttagtttctctggaagacgttaattggcctttatatggatgctggtctttcgacatagagtgtttgggtcaaaatgggaatttcccggatgccgaaaatttaggtgatatagttattcagatttctgtaattagtttcgatacggaaggtgaccgtgatgagcgacatctgtttactctgggaacatgtgaaaaaattgacggcgtgcatatatatgaatttgcgtcagagtttgaattacttttgggttttttcatatttttaaggattgagtctccggagtttattaccggttataatattaataattttgatttaaaatatttgtgtataaggatggataagatttaccattatgatattggttgtttttcgaaactgaagaatggaaagattggaatctctgtccctcacgaacagtacaggaaggggttccttcaggcgcaaaccaaggtgtttacttccggagtgttgtatctggatatgtatcccgtctattctagtaagataacggcgcagaattacaaactggatactattgctaagatctgtctccagcaagaaaaggagcagttatcgtacaaggaaataccaaagaaatttattagtggacccagtggcagggctgttgtcggtaagtattgtctacaggactctgtcttagttgtgcgtctctttaaacagattaattatcattttgaggttgccgaggtcgccagattggcacacgtcacggctagatgtgtggtgttcgagggtcagcagaagaagatatttccctgcattcttacggaagcaaaacgccgtaatatgattcttccgagtatggtgtcttcgcacaatagacaagggataggttacaaaggggctaccgttttggagcctaagacgggttattatgctgtgcctaccgtggtgtttgattttcaaagtttgtatccgagcattatgatggcgcataatctgtgttatagtactttagttttggatgaacgacagatagctggattgtcagagagtgacatcttaaccgtgaagttgggggatgagactcatcggtttgtgaagccttgtatccgtgagtctgtgcttgggagtctactaaaggactggctggccaagagacgagaagtgaaggcggagatgcagaactgttcggatccgatgatgaaacttcttctggataaaaagcagctcgctctgaaaacaacatgtaactcggtgtacggtgtcacgggagcggcgcacgggttattgccgtgtgttgcgattgctgcttctgtaacgtgtcttggaagagagatgctttgttccacggtggattatgttaattccaagatgcagtccgagcaatttttttgcgaggaatttggtttaacgtcatcagattttactggtgatttggaagtggaggtaatttatggtgatacggatagcatctttatgtctgtcagaaatatggttaatcagtctctgcgaaggattgcgccgatgatcgccaaacatatcacagatcgtctgttcaagtcgcctatcaagctcgagtttgaaaagattttatgtccgctaattttgatttgtaaaaaaagatacattggtagacaggatgattcgcttttaatttttaagggggtagatctggtgagaaagacttcttgcgattttgtgaagggtgtggtgaaagatatcgtggacttgttgttctttgatgaagaggttcagactgctgctgtggagttttctcacatgacacagacacagttgcgtgaacaaggagtgcctgtgggtattcataaaattttgcgtcgtctgtgcgaagcgcgggaggagctttttcagaatcgggcagacgtgagacatttaatgttgtcctctgtgctttccaaagaaatggctgcatataagcaaccgaatctggctcaccttagcgtcattagaaggttggcgcagagaaaggaagaaattccgaatgtaggtgaccgaattatgtacgtgttaatagcaccatctattggcaataaacagacgcataactatgaattagcagaagatcccaactatgtgatagaacacaagattcctatacatgcggagaagtatttcgatcagattatcaaggctgtgactaatgcgatctcacccatttttccgaaaaccgatataaaaaaagagaagttactattgtatttacttcctatgaaagtgtatttggatgaaacattttctgctattgcagaggtaatgtgaatgtatttaggttttgtcgtttgtacatgttaacaataaagtggtttaatggaaacctattaggtgtcctttgtatttttcgagtctgtcgcttatttcgtttgggatgtccatttcttcgagttttttttgaagcatccctatgtcgatgtggatattagtattggtatctagtgtttcgcagaggacagttaggattacactttcttgtagtatatctagataaacgttgtagcccgaggataccgctactatttgtttaatgcattcacaaggaatgtgcagagtgcgagactggaaaactatgtgcattccgagcttttgttttctttcgaacatgatagggaatatgttgttgatcgtgttgtggacaatataaaagatttgaaagatagtgggttgtttggcggacattcgtatgagctccatgtcctttcgaaaaccgtagaagtaaagtctgttttgcatgacgttgttgacttggttcaagtgggcgaccattgcatctgaggaggttggaacggagacggattcgcagtgtaggcaggcgcttttggagatttgttcgttagcgtagggggagaattctaggcaggtgtgttggtggtgattgctgagactgaatgggacgtcgatgggttctttaccggtaattggcagttttatgatcgctagaaatttctgttcgtattctggaaacaggttgaagacggtgtgtagatcgtgaagtttcagttgtaagtaaagctttgttttttctctgtgatcaggtcgtttttgtattctgtgtgtcacggacaggcttcgcgatcgtcgaatacggctcttgtgtacagtcattcttcaaacgtagtagttgacggtgaaaatgggatcgacgatatcgaagtggtgaagtgctaataggttagtgaagtctttgagaaactctgtaatttgagttttatttttatggtttggtttaataatctgaaaagctttgaaaagatgtatcgctagccaaacatgtttttcgacgatgcttaaatattcgttacggtagcatatggtgactttcaagtcttggatttctccggcgtctgtagtgttgaagagaacctccgggttgatggttttacagtttgctagacacaggggatcacaaaagaagtgcttatagactcccactgttccagtctggcggagtatcaggtaaacgtgggtatcgagagtgaagttatcatctgagaatgagaattcgttatcgaatatcgccttgctgtagtcggaaagatttttgacgtgcgtgtgtatttttgtcttctcgaagatatcggcgatgacgaactgaactctatctatcatctttaggttgttttgacagtagtccatgatgctctgatgtagatattttaaaaataggtaatcttgtttggaagctgccatcagttcacataggagacagacgctggttgttttgtttttggtgatagaaaatggaatctgtgccaaaagaatgggaccagctgtgagttcgatgtcggttttattggaatacaggtttttgatgaagcgatgtttgcggatagttaggtccgtgaagggaactcggtcgaagacgttcgtgccagaccacatatagaataagagtgtcgtgaagcgagtcttcatgggcactgtgagttttttattcagttcggagctttgtgtttttttcgggttcatttttttggttagaaatttttttattttgatgtgcggtatagtgtcttcttttagcagggtcgatcggattattgccatgtgattcagggttatgttttcgctttggatgtgatcgttgactgtatttgcgaagcatctgtgaataaaaaaatgaacgtgaaagtcaaagatggagacaatgttgtttagaaaaagaccgtcgaaattgatgtttggaaatcgttcccgtattaacattaaaaattctgtggaaacgatcagaagagacagtggagtttttggcgcgtagttgcatttgtagcacagtagactgtagtcgtagatccatgatttgttttgtttgaggcacagatttacaatggagcagatgttgcatcgtctgtctatatttaatgcgacggatagttgctttaattcctctaggttttcagagttgtctaaattggatatttcgttttctatgtttgtggggctggtggctgttgtcgtctcggaagggatcggtggttgaggagtgaggtagcaatataacagaatctcgtttagtatctcagattgtataggcaacgcttctgagtcccatcctttgtacatgatggattcctcacctgaaaagacgaatcttgaacttttgtatgagcgagtctgtgagcagggaagggagtttgaggtcgtgttttatccaatgttgccacgattatatgaaatgatgcttccttctttggaggcgcgactgaattttcttagtgttggatatagacacgttgcttttgctagatacgttcacggggatgtcgattgcgtgcatagagaggtcatggctcaaaaaatggtacttcttacttcgatattgtcaaagctgttaaatgtaaatggaatattagaacatcaagaatatttaaatacggaatagcttttaaataggtgaaatggctaacgtactcaaagaaaagatgtacgatgaactactgagtgcgacctgtcgtatcttaaagttggggtctcatgactataggataactgagcggaatctattgtcgaagaacccgaagtttcctttgtgtgatatcattctcaagttagactacgcttataatctagaatatctgctaagtctttgggaacatgtaactaagcaggaacccagatttgtgttcaagaacacaggtggagctgtgtcgatgtcttgctatttgcatgccccggttaaagtagaaggtcatcatgctgtgagagaatgcaacatcctgcgtgttaatgaatgtttgactgtccgcatgagcgacatagtggctatgaagccttcaacttttgcagtgttcacgaaatgtataatcaggcgtaatcgagacgacacttacgttgttgagtttgtggcgttcggacctgaaaacgaatctgaatacatttcgcttttgaaggcaattttcttaaagaagtgttctatggggaaacagcatctcgaatcaaataggttttgtcaaggtttgagaagaaggtcttcacatgttttggaaaaggggcgattcgaaagtagcgggaaagttgtaaataaagcttctgcggttgtgacatcacaggagagtataaagcagttctatgaaaaagagaagtcattactgtccggtgtgaagttttggagactaagtgaaagacattgtcggtttgcgcttgtcggcatctgttttcttttagccttgtatttttgttatgttctacttaaaaaaactcctacgccagcttctggctccgttgtgtaaacatgggtcgtacacgcatttgcaattgtttgtgatgggtgaggcctgtgtgccaggaaagtgtgttcttacaatgtttttgacaaataaaaaattcttgaataaggaagtaacggaaaaattttataatgagtttttcgcaatttggttgcgttgcaggccggagacgcgattaatcactaagcgactttttaacaaaatggttatgacaaagggtctttttgttttgctcgcctatctgtatttcgtgtatcggcagtgtaaagttctcgaattgttgtctctttataaacttaaaacaatcaaatgggtggacgtcgagactagattcagggtttatcccccgtacaagcttaataagttgttggagatgccctcgttttccgaaatcaatgagttgcacatgttcctgttcgagcaacagttgttgcttccgattccgacgcacgtgaacttaccgtgtatgaggctattctgtttacgtgactatgagcagaccgagacggtgatgttgcgatataggcagagagagcacgttttgtcatttccctctatgttgcgaaagtatgctttgaaatctccggcggggaatttcatgtttactatggcaaaggctttggtggaaaacttctgttttagtgcagacagatatcttattccagtggagcataataatctagtacctatggtgccgagcaaacctgaacggggtgattttccaaagattctaacctttgcgttggcgacgtccttaaaggatggcttagctaccagtgttatttcgttacccgttatgtgctattgtaagactaaatgttctcgctttatactcgaagagagttacatttgcgttatttgcgcaaaatgtggtcactgcttaaactccggaaaagaaaagctgtgttcgccgcagggcttttcgctgagctccatgttctattttagagacaagcaggagaaaaatttgatatacagcatgcacacggatgtaatgtattgttcgctgtgtgggagtcagcagttggtgttcgagcggatatatgagatgtctgagcattgtgtattggggatgaaggtgaaaaccgtttcatggaaggcggtgatcggaacaaattctgcttgcactattttaaatgacaatgtgaagttcgatgttattgttccttgttcgtgtagatcctgttattctactgtgcatctctacaacgtgaccgtcaagaagttgttacggcttgtttcacacggttctgattttcagtgtcagcgctgtcagcattcgtttagagagacttgcttagatctggaagactgtgttaatatctgtcaaggttgccagatttcccaaaacgtgaggtgtatttgaaatgacgaccatacgtagtgatgatttgtcgaatcagatcactcagatttcaggttcttcaaaaaaagaagaagaaaagaaaaagcagcagatgcttaccggtgttttggggctgcagcctaatatggccagtcatcccgttcttggggtttttttgccaaaatatgctaagcagaacggcggtaacgtggataaaacggcgttccgactcgatttgataagaatgctggcgctgcatagactgaacacaaaaacagggagtgattgatgaaagcttcatttatttcgtatgtttggataataaacatttataaaaggagtatgactgtgtgttgaatgttacagatacatagattttaattttgaaatagttgtatttatcgattcggagaactcgttgattttttctcgagctagagtgacatcttttattgctgcgctggccgtgttagcttttacgtctggactggtttccggtacgttggtatcagtggataggatgatcgattggctcttgggcataagtccagtaacggcaggctttttaaactttggttcggagaggtttttgttggttaaagtttcagaggtttgtttacccgggcgagtagactcagtattgttgggcggaagttggtttaaaatatctgttgtttttgggtagagatggaaggaaattaaatttgtcgcttcgtattcttgcacgggaaagtggaaaggatttttgatgtaaaaggcgactttttttggattggtggacatcggcggtagataaacgttgacaacttcgttgtcataattaaataatatcaaaggaatattgggtgtcgctctgtttgtgtggttgaggtaggagacgattttatcgagctgtactgaaaagagtgaatgttcgactatgtttttagtccatgactgtttcaggatgtagtcgatgtcgaatgtgcgtgctctgaggacagattggaagtctttatcgtggagtacgttttccaggtgtctcatgcaaagcaggtatgttttttcgatgatatcgatgtacatggcgaatgtcatttcataccctgtcaagaaggagtaaagaatgtagtcgaagacatattcctgagcctgcaggcgagtgagtgtcggtgtgttttgtgctttgtgtacggtgatttttgaggtaatcctttctccggattttattgtgtctggttcgtggggagttaccgaggacgtagtgatcttattttggtgtacgtattcggagcataagtccttaattaggttttgataagatctttgggtaaaaatggccggtttgtattgaatccagatatagttcataaatttgtagggtagaattaaaaaggcagtgagatagataaaaaacttttcgtttttggggcacagttgtgtaaaaaatgtttgttggaaggtatctttcataagtttggcgggttgccatagctgggtgtcgatacatatatttctcattaaatgcatgggcttctcgggagggttgtggctaacgacgaatgtgttatagagactgtttttgtctatgcttttggctaatgaatttataaccagatctgtggaatgactgaggcagccgtagaggtattcaggatgtgagcatagtatcaaaagtgtgaattgcttgatgggtaattcgaacgctgtggaaacagtactgtcttcagaggctgtccaggcttgtgttatgcagtatataaataatttcaagttcacgatcggtatgagttctcttttaaaattttgtgtaccgtctctgaggtaagggcctaggtccagggtgattatattctcccagaactgttgtagtatcattatgaaagatttacatacggacaggagtttatattggctagataccaagcggggggtgtcttctggtacattaatctgcttgtagttcagggagaaaaactttactatggcgttgttaaagatgttatggaattgcagcggaactcctgtatcgtcaacgattaggtgagttccaaagacggagtttacttggtagaacacttgacgttcccgttcaatcctgaggcgggcatataaatccgaaataggtttgacattcgctactgagtaatcaatcgggatgaaattttgttgctgaaagaccgcccactgtttcagaagtgtgttctggatgtagttttgcgctgccgttatgaagttgaggagtgcgcgcagaccgttaatataattttctgtgttgagtgagtcagaaagtagatcattttcctgtggaaatttttcaaatggctggcttttgggcagcgatttgaacttctctattagccgttccacattttgtagttgctgaggaaagttgaatgctaacttgaagctggcgacattattgacgatctcaaagtattcttttttgagttgttctttttcgtaggtctgttgcatagaagtttcggaagtgagaatcttgttcatgagagtttgatactgttcctgcccaccggcaacgcgtttaggatctaactgcttcaagagcttagtcagttttggaatgtttttcgtgttttcgaccgtttcgttgcaaatgactttgttttcaatttctacgtatttggtgttgatctggtactccaaatctcgtagggctgcgtaattaaatgggattgcttctttaccgaattcgcttatagctgacaggcagaatttgttgatgtcgtgtattaattttgttaaccatttgagagttatctctgcttgaatgtaaggcatctcgttggttgctttgttcattagctgacttataactttaaagggatcagaaataaagtcttgcagtttgatgttaatgaagtctgggatgtagagcctggaatctgaaacgaaggctgtccatttcgtatcgaatgaaagttttgttatatggttctgatccattttcgcctttaggtgtgcgttaaagtggtttaacaattcctggagttgattttctttattgttgacttccaccgtgagagctttagcgaatgctgtttctttgaattgagtgttttttatttctttcagcgtgtgcgtatttagaactagataaattttgtcagtttttgcatcttgtgacgagagaagaatttttttttcagctaatgcgtattctttggagagctgttctttcattttgttcgtctcttttctcagctctgtaatgcgctcttcgtagaggtttaattcttgtccgtagatggagtggctgagtctagtatgtttattggtggaggtagcaattttcttgaggaacgtgatactcttttgtacttgttcgatttctgtttttacatcttctgtgcagaatgttgtttttttgaacttggataagaaactgagtaaaggggtatatttttgttcttccttggacatctgttcggggtttagaggagttttgattaatatcttttcaataacgtcggagatgatcttgctgatggtcgtttctatgtcttttaacactggcagtagtgcatgggtaaagtgaatgatgacattgttatcttgcagttgtttcagaaaggtttctaaaagattcaaatgcattgtttccagagacgaaaattgaccatcctttagaataagtaagatgtcggtcagtcttttttcgagggtgcttctgattgtgagtatgtgttttttgtcgttctcggcagtttgtttcatttgctcttccatatgtcgttgtagtgctttatcgaggtcaggtttgcaagtttgtaaggcgtgtttagtgggtgcagtggctaagaaggctgtcagttcttcgggagatgtgatgacgaccgtttttgctctctgtatccagtttttctcttcagtggtgattattttttgagagtagagaaatttgatatgtcccatcagcgttggtattttttttccaaaatgctgtctcatcatgttttgaagttgttcgctattcgtcgtgatgaattgggccagatcgtcgaattcatctagagtttttaagttagcgcatttctttgctaattgccgtagcgtgagaacggattcgaacagtgctgttttttcggtgctgtttgggaagagatctacaagaaatagaacggttgaaaacgtctgttcagggaccgttatgtcattgagcatgtcgtctacatatatgtcaagtatggattgtattttatcgtgtagagtcatagcgatatctggtcgttgttctaagatgaaatggaggtgtaaattttttacggttgtagtattaggtaggttataagcagagaggtggtgcaggaaatcgtaaatgggggttaactcttggtcccctaggatttgttttgtgattgcagctgtctgtttgttttcggtggtggagatttccattttccccagttcttcaagttgcgatttgatcatttctatatttacgactgtcttgtttttgctgggatccgctaggatggattcgattgcggctaggatttcggaagctctgtccgagggtttctggctgttatagaaatctacgaacatttttctgatagatagggtaaagtttgaaaggttgtttatattgaagtgagaagttccgaagcgtagaaattgcgtgttgtcatacagtttttccacctcttgaagcaacacagtgttaatgtttaggccactgtgttttaaaacttcaatgttaaaataaaggtttactaggtaggcaaataggcaattcagttcggtaacgggcatgaaaccggcagcgatattgttatagttatcttgtacgattttggtgaatttgtttgtgagcgtgtgaatggtgttggtgagtttttcattgagttgtttatctagggatatttgttgggtgttgtttagcgtggagatgtttggtagttcaatcgattcggttatgaaacgcggaacgatgccttcagtgatgtcgctcgtgtgaactttgtgcacgttttctgattctataggaagtgcgggagtttcgccaagtttgtcaataaaattagagagttgtgcgaaactgttcttttctcgttcaatagcctcttgaatctcttttcgtttttcgtttagcagaacagctactttgtatttttctgccttattcagacaaatgaattcatgaaagtgtttcacagggttatggtccacgtaggcttttagataattttctatgtcatctagtttttttggcattccttggaacatttgcgtggtccacgatttgacccattcataatgttttttgtgatcattatcaactattgccagaaatttacttagtaagattctctcgagtgttcgaaaggtcgtggttttgcacaggtaattattgtaaatgaagatgatgtccagattgttttcttgacaagctgccaacgcctcgttgaatacttcggaaaagtccttgaaaggcaataaataatttatgaaaatagtttgttgttgttgtttgctagaatcgtcatttgtggatccgacgcctacaaacacgtcgataatttgacacaataagtggaaaactctgttccagagaaagggtgttgcgaagggctgattaggattaataggagaatcttgtaagtatatggtccagttgaaattagatttcattataggaaaagatttgagatcgtgaaataaagattgaaattgtgatcgtagttcataaaaactcggaatgaggtcaacttctgttgcgtaatatgtcaaggatgcggtatcttttttctttttgtcatttagttctagttctagactatgagagtttttctttcttttatggggcgcgtgttctagatctgtcgttttatccgcaacgaggtcctgttgcgatccgatatcatctgttttttttatctcatggatttccgtggaagaaaatttatctagcgcaatcgctatgtcggggtctttataagtttttaggatgagaagctcggcgtcgtgactagagagcgacaaattggaggtttctatgaaaaaaatgaggctggcgtcgtagtagaagccttcggtgccgtgggtggtgagcagttcataaacttcttcaatgttttgacagatgtagatggctgctgtggcttctcgttcagtagggtgagagtcgaataagtagagagtattgttaagaaaaaaaagtgctcgcgatagcacgccgatcgtgatgactgcaaaagtaggaccattcttgcttttgccatacagtatgaaatctatgagtccgagatatacctcattgtcaattttttgtgtgtctagggttccgttaaatggccgtgagagttcatgctgtgtgacaccgtatctagaatggatcctcttggggatctcggtggggagtctgtagtcttgcgaatctgagttatttaacattagggctaaggtgccggccgtgtctaagtgatagccttcttccattatggcgtctatagtacccgcattgagagaattgttaattccgtttaagtaaacggtatggagaaatgaaaagctgttcgacatgcattgttttccggctctcggtccgtatttagagtcattttggtttgtgctactggtaatgattttcatgggttagaacgcgaccgttaaaatttaagaggagtaataagatcttgctgtgctgcctcagcatgtgcagcgtaccagtttaattgtcgttcgacgtgtctgaccaggttgtacctatcgtcaaatgtatcgagaaatggaatgtggtcggtggttagtttttgggtagacatcaatttcttatgtaaacttgtggtgggtttcatgctttcaaatagttgtgttataaaaggcttgaaaacggcaactgcgtcctttttaatttcgagtattgtgaaagaattgttcgaaaccgcgaggttggcggcttccagacatctggaagctaacgacgtgtttaggattgcattggagctgagtacatcaactatgtagatgatcttcttcagggattcgattaggatgtcgtttgaggttttacatttttcgaggttcacggaaatagaatggtatgtttcgtttacgtgttgggagatgcgttggacagtgtcgatgaatttttgtagtgcttcgttggttagcagctctttggaggaggagacgctcgtgattatgtttcgtagcatccccgtgagtgtgatttcggaaatttggatcgtttgtagtgatttttcgaattcttcgtgttgacgtactaaattcctgcatgtagcgatgaaggagcaaaacgaagtggtgacaattttgtctgttccgatagttatgtagataaatagattgtctaagtttatgttgcatttggtcgccaagatgctggcgcattgtttcgtgaaagttatgtacgtctgtatcagggagaagtttgccgttatggtttgtttgatccaagggtttacgtatttttggaggtagttggtatacgcgtttagtagaatgcttacgagaaggtttgtctccggggagtagatcgtatgcgtcatcacgtttatgtggtcagcgattttaaagattacggactttattacggtgaaagtgcctagatctatatggtccacgtttatggagaaggcatatagccacgccatgtagtgtagtagtagatgttgcgaggggagtaggagtttgcaggcgtggattagagttaagagtctgcaatcagattgtaatttatcaaaggtaagattggtaatgtgtgaaaccataggtataacgtagattttaacgaataatgttttgaaagatggatgagtgctgtagggaagtaaagattcatatgcgtccggggaatcgctctgatagacctctttgcagatgtctcttagctcaagggttgtaatatggtgtgccgtagagttgtttgaggtggataccgagtacgtgaaagggaaaaatacgttaccccatttttcgaataggtttttgtatagaaactgtttttgatcttcgtttcctcctttggtatattctttaaaaaaggattcggagagagagacgttaaagagacattcgatgtgatcagatatttgcttccagagtgtggaataatcatttcgttcgatgatcaaaatggctctctgttgttctagtatgagttttttcctattatagaatatgaatgttgggctaaaattttccatacagataaaaaacacgtgcgcggtgaaaacaatatgggttaagttaatggtgaatgtattgattatgggttgggtgtctggcgttgccatgtggtttgagaggatctcgatgtaggttctgcacgtttccatgtttaaaccgattctgttgaagtgaaaaattgtatctagcagttgggataacgatgcgggtaagcatgagcttttcgtttcgataacctgctggatgacagtagcgaaaaattgattgattttattgagatcattctcccgttcttgagggattgttttttgatgaagtatgtgatagatgaggcctcgatggaagagaatattttcggttccgaggaagtcgaggatggacaggtcggttttaagtagtggatagatatataatccattgtcctgggctgtgagattttttgaaaatattttcaagctaaacgttttttgataaagtagttctgggctgtttcctgaggtgtcaaaaaatttatcgagattcgtgaacgtttgattgtccaacgtcttttcgaacagatctattagatggcgatttgaagaagggtaatatgtaaaacagtagtccattttcaacagcctgtctagaaatgtgtcgcctggaaactgaatgtcttcgaaagtgagaacgtgcagaaaccatgagtaaagtttccgatatagatcgtctatcagctctacgacggcgcggcagttggcaagaagtgaattttcgtgtgtaaagctgtttatcttttgtatgatcgactgaatcttggagtattttatcgttttatctgtacctgggtcattggcggcgggttgtgctcgaagcttgccgattggggacgataactcattttttagcattttaatggaattgagtattcgatcgaacacgtaaaggacctctgcattatttaagttttcaagttctgtgcccgacgaactcgaagagggaatttggctgagttcttcgtataaaagttctgcggagagcaatttattttctgatgttaaggtcgtagagtttaaaaagtagaataccgcatactgtctgatgaggtcaaagtgatattttttcggggttagtcgattaataaaagctattactctgttgtgtgttacgctatcggctgccagggataaaagttcgatttttgccgtagcggctagtaatgattctggagacgtgctgtttttgagtgaactaaggatgaactctaaatcgagtgcacgagctgccattgtggatactgtggaagctgtgaagaagagaaaatatatatctatcgatgagggaaccttaaataatgttgtagaaaaagaaaggaaatttctgaaacagtttttgtccggcaggcagaatttacgtatagcggcaagggttttcactccttgtgaattactggcaccggagctggaaaatttgggaatgttgatgtatcgttttgagactgatgtggacaaccctaaaattctgtttgtgggtctgtttttcctttgttctaacgcattcaatgtgtctacttgtgtgagaaccgctttaactgccatgtatacaaactcaatggttgataacgtgttatcgatgatcaatacgtgtaggtacctggaagacaaagtgtctttgtttggtgtgacgagcttagtttcttgcggcagcagttgtctgttgtcatgcgtcatgcaaggaaatgtctatgacgttaacaaagaaaacatttacgggctcacggtattaaaagagattatactagaaccagactgggaaccgcggcagcattccacccagtatgtttacgtggttcatgtttacaaggaggttttagcaaagctccagtatgggatctacgtagttctgactagttttcagaacgaagatctgatagttgacatcttgcgacagtatttcgaaaaggagcggtttctgttcttgaactatcttattaatagcaataccacgctgagttactttggaagcgttcagcgtattggtcgttgcgcgacggaggacattaaatcgggttttctgcagtatcgtggaattaccctgtcagtgataaagctagagaacatattcgttgacctttctgagaaaaaagtgtttgtatagcttctgagccttctgcctgaaaatgaagagaaaagagcgtcgtattaataaagattatggctacaacagaaaatgcgtttgtcattacgaagcttcgcaaaaacgtttttgttattctcaatattcatgcgcttctgttttgtatgaacgggttcgtgacatcgctaagataatcgatcgtctcgactcaggtttagatgcttggtgtttgcgggatgccataatttctgttttgagagctacacattgcgttccacgagtggatcgaatgctaggaagatggtatctgaagacgagtgttttttacgatttttgtccggacgatttaattttatcatgcccgaatgtgattatgccaaatgtattgaactttgtaaagaagtatcgagattttattcgcagcgtactctataaagtaagcgtgagttggaaaaaccaatatatgcccggagttttggccgcatctcgctttttagaagaaatttccaattctttaaacggtgtcgaagagagtattccatgcatctatcttcgtatgtgtgctactttgacagagatcgtgttaagaattggttatctgcgggagatatatcaggagaatccttacgtgatgttcgaagaactggcgttttccctttttactcaaaaatgggttttaccgttttcctgtatgacaaatttgggcctcgtggaaaaggctaatagcacggtttttgacgtggcgatttacaatacatgtttatattcccttgtggattttacaatagtaaacggcgaacatctttttccggctttgttaaacggttctaatataagcatgaatttgactcgttatcaacaggaagccaagaatatttttgagatattgctgtctcaaattcgggtggtggaacgtgataccgataagacggttcagttgacagtctatgtggaagtctggcatgtgtctgcactaatgtggctggacttgtatgaagctttgcctcagacttctcgggtcacattttgcttgatcattcctgggattttcatggataggtacgagctgaaaagggcgcagtggtctctttttcataaaaatatagcttttgaattaggaaagtgtgacgagataactttctcgacaaaatatttggagtttgagcggacaacagatcatgcgaaaattactatgtctagttttatagaaaaaatttgcctttgtttaaaagggggcaggatgggacttattttccgaaaaaacgtatatcaatattctatgattcctcatgtgcctttgtattgcgggggtgattttttggatgttttacccgtcagagacggtattaacacttgtatgagaatgttgcttaatgtggtacatttcttgggtgacgaagtaagcgatgagctaactgaggagattgatttcgtgcgtttgcagtgtaaattttttatgtttaatgaattaaggcgggttgttcgaaaaatggtgttggtcgctaatgctgtgattgattatgctgtagaaaataaagattttctgtgtgagggaatcgaagatggacgaagtctaggtatctgtgtcacgggtcttcattctgttttcatgactgtcgggttatcctatgcacatccagatgctcgtcgattatatcgaatgatatgtgaacacatttattatacttgtgttcgaacgagtgtggattgttgcatgaaaggagcagagccatgtaatttatttgacaggtcaaaatacgcactggggatgttatactttgatcattttgataatgtcgaatgcacgctcccggaggaattgtggacaacgctaaggaaagacgtgctgatgcacggagttcgcaatattcatttcaccgccggtactgccatgcagaaagaattcgatatcatcaactcttctgaatcgttctggccgatggaagacaataaaatcctaaggcggtcaaatatcaaagtcgtaattggaaaagacggtttaaatgatgtcacttcagtttattcgtcggaattaaaatcgttatatatccccgtgtataacaatctgttgctcaacagatttaacaagcatcagcaatatttgaagactgtgggatatagggtattaaacgtggacacgaacctatttacggacaaggagttggatgatttagccgttttcaaagatggttttagttatcatttgaatgatttgattgagatgtataagagtggattgccttttttagatcaggggcaggcaaatgtgttttatttcaacgatactgtgagtttgagactcttgctaccgttgctgtataaagccggatttaaagtcgctatgtataaggttttgtgtaattctgagatgtataaacaccttgatttatcaaatccgttaccgttgatcgggaaatgttcggatggtgtggttatgcacgtaaagaacattttgtagtgatgtaataaaatgttggcgccaaaaaaatacagtatataatgtgttggtcatttcatttgttttttaaagcacataaggcgcgagttggtgctaggacttcgttcttgacagagatggagcgcggtagtcgagatcatcatcgtgatcaccgtgatcatcgggaacatagagaaacgagagaaccgccgaccctagcttttcatatgaaaagctggaaaactattaataaatcgcttaaagcgtttgcaaaactgttaaaagagaatactacagtgactttcacgccgcagccgtcgataataattcagtctgctaaaaatcatctcgtgcaaaagctgactattcaggcggaatgtttgtttttgtcagatactgatcgttttttaacgaaaaccattaataatcatattccactttttgaaagttttatgaacatcatctcgaatcctgaggttacgaagatgtacattcagcatgatagtgatctgtatacgagggttttggtaacggcttccgatacatgtacacaggcgtcggttccctgtgtgcacggacaagaagtggtgcgagacaccgggagatcgccgttgaggattgaccttgatcattcgaccgtttccgatgtgttgaaatggctttcacctgtaactaagactaaacgctctggtaaatctgacgctttaatggcgcacattatagtacaggttaatcctccgactataaaatttgtgacagagatgaatgaactggagttttcgaacagcaataaggttatattttacgatgttaagaacatgcgatttaatctatctgccaaaaatttacagcaggctttaagtatgtgtgctgtaatcaagacgtcgtgtagtttacgtacggtagccgctaaggactgtaaattgatattaacttccaaaagcacgttgttgacggtggaagcctttttaactcaggaacagctcaaagaggaatctcgctttgaacgaatgggtaaacaagatgacggaaaaggggataggagtcataagaacgacgacggaagtgcgttggcatcaaaacaggaaatgcaatataaaataaccaactacatggtccccgctaaaaacggaactgcgggctctagcttatttaacgagaaggaagatagcgaaagtgacgattccatgcattttgactacagctctaatcccaatcccaagaggcagagatgcgtcgtctgacagatagttttattctcggtcttgctaagggtgccgttattccggggttgtatacgtttagaatgacagaggggaggtcccccctcggacagatcggcgttttgataaccgttgcgatttcctttttgttgacttttaaaagatttgatccacgcttttataaacccataggtgatttcaagattgtgtttctgtctttaatggcgccgaaactgccatcattattgtctgcagtggtcatgatctgcttgatattttccgagatgaggttgagaatgattttaagtcgttgtgtcatgattatgccgtcttattccccagctgtgtttacgggaatcatggtgtctttgttttttaagagtcaaatgttcgatgattattctgtcttgataacggctgcgtctctcctgccgattactgtgagatatggatggatgatacgatcgtctggattccttcttggtttgcaaaaatatcgtccgattttgaagtcaacgtcgtttcgtgaagttgatttgaaatgccttgtaaagtttacggtcgaatttttgttattatttacgatgctctggatcggaaaaatgttcttgagtatgccaaaatctaaccatctttttttcctgactgtggtcaacaacgtattttttaaactaaacgtattcaaagccgctgcgtgcgcggtggtggcgatcttatcgggacttatgatgaacgtctgcctatatcgaattatctttgaagcctttgtaggtctcgggtttagttcgattatgttgactttgagcagcgatctgaaagacagatctttctatgcgggtgatttattgaacggttttttttgtttagttgtgtgttgcatgtattttggtgtgtgattagacaatttatcgtgcctgttttggtgaacaccaataaaattttttgcagtattaatgttttcccaatttgtgtttatttgccctgagccgggcagttcatcgttatgggtttgtcttcaagcaaagacatcgatttgctggtaaattttatcgaaaatcgccagggcgccacgttagctttaccctggcccgaggattatcgattgactctgcatagtgtagaaaacatcccggaaatttcacgtgaagatgttcaaaattgggcgaagacctatatgtgttgcggaggcgaattggttgtggttggggttatacataaggcaaaaacgagaacctgcaggggaccgattgtccttcagggggcgcgggggcacatctatgtgtataatggtttttttgacagaagtctttatcacgtggcttcttcttttcacgatttgttttctaatggtttgcggtttttttatccgatttatgagacgtgtgattatgcactggacagtactgtggcgctggatatgattgctcacagtaaatcgttttctgagctcttacattaccgaaatgaaagaaagaatgctttttttaccttgaaaacatatccgtacaagacctttgttcgcttttgcaatctgagcatgactgagttttctagtagacatttgattcagtggcgaaggaaactgcagacgagtctactagatgtagtgtttattgtacagcataattttttcggtgactggagggagctcgtagtagtgtttgacggccacggtatgcttttttgcgtcgaccgtgaggagagccttctcttcatagctcgcaacatgtccgattttttaaaaattggatgtctgcgttataatgagaatcgtcggttgcatacgcaatggtttacgcaagatacggactatattaagcaggtggatgagatgttttctagagacgtcctctgtcctctccgtgagcactgtcagaggtcgcgccgagagcgaggattattaaagatatgtacgtctctagtcaggggggttaattgtattgaaagagggtaggttgtattctcctaccatgttgcttataagcaaaactctattccccattcctagaggtgccgatgaattctgggaaggaacatacattctcgtagttgcattcgtgctcgcatttctcgtttactccgattttcttagtaatttaagtccgtttggagaaattttatcttcgccttgtatttcaacgtgaatcttcgtcgtgaagaggatggatccccctcggacgccgccgccgtcctattcagaggtgctgatgatggacgtcatgtgtggacaggtttctccgcacgttatcaatgatacatcgtttgttgaatgcataccgcctccgcagtctcgcccagcgtggaatttgtggaacaatagacgaaagacgttttcttttttagttttgacgggcttggctatcgcaatgattttgtttattgtgtttgttctttacgttttccatgtgaatcgtcaaaggcgatgaattacctgttttagaaacatttgctgatgcgatgtggagcggaaacatgaacattgaaaaatctctattggttaaaaggaatagcaggcattgactattaaactaacatagcgaatttgaacgtatgaggaaatctgaatttaatgcaaaatcgtgtttttttatgatcgacatttgtatttttaatttgaattcgtcgagttgtattataaaaactaattcggaacattgttctaaagatttttattctgctatcttggtgtgggtgtgattaaaaaaccgctgcacttgggcaatcgcaaaaacatgttgttcttgtcttttttactcgtgtgtctttgtgaagaggtgcgaatgctcaacctaatgactacagaagtttcggcaactgaatttgcatcaattgcgtctaaaaacatggaaacggatgtatcgacatccagcgactatttaactgggaaatccgaaaccacgttttcggcgaattctgaaacgtggggtaaaaatgttaccgaaatatctatagattctgagacatatttaaatcagtcttttatggtgacctctacgttagccgtggaaaccacagatcgatccattggcaataatgtaaatgttacaagttcgtttccgacggtcaagggtgatgagacgcagaacattgagacgtctttcacagtaatatcggcgtcgacattttccgatgtgtctgaaaagacgcctcagggtttgtcgacgaaatccacaccgaaaaagacggttcaggctctttgggaaactgatactgttcaagtccttgagtttacagatacacatgagggagatgaggagtattttaaagattttctaagttcattagtaatttggatcggcgggattagttttatcggggcgttcgtaattctgatagtcattttgtgtaattggtataagaaagacaagcagaggtctttgttttgggatgaagagaaaaaaccggatgtacaaatgaggagggatgtaaagacttgcagatgaggttctcatagattgttattagtgattatggtgcctcagggttgtagtttagtatgggtgagtgcattatacgtgtcggtgatagcgtctttgcatattattaacaatgaaaattcagtttttatcgcaacacacagtgaaacggagttaaggcattggttgatttttgtaaaaatggctcagagaaacggaactgcttggtggcggatggctagtgtgcctattaatgcttatttcgaaagagatatagcctttttgtttaaccctcgatgcgttatcgagaccgccatggggtctaagatattatgtcgatacaataaaaatattggtgttgtgttcgtggacaatgatactaagtgtaatgtttcctttccgagcggtgtgcagttacaattactaaatcaatcggtgatggagtcaattagaactaaaacgtatgtggtggattacgctagaaaaactacagagaggggtgattgcttcatttctgtagcattctgccgaaaagagagacgacgctttttatcccgctgtgagcgctttgtttattactgtatctcggtttacctttttgctgttgtggttctttgttcttgctggtttgctttggatccgttgtttaatatgtgggcgtaacccttcgacgttgtggtatgacggcgatcttatattaaagatcgcctcgctggacttagtggacgctagtgatcacaaaagagaaggaaaacccagcatgatgatctgccttgttttcttatgcgtcttgacgttagctcggggtgaaatctatcctcccatttgtccggcccctggcgtagggaacgatgaagcggttagagctggggagttgctgttagagatatctgcatacagaaatcaaagaagcggtagagtggagttgtggggcagtgcggcggtcaacaaccaagtgttttatggaggaatggaaaacagtcaaattgattatgatttcggaaagtttttggtttttcgatgttttcaggtttttaataacgtacataaactattgtttaataccgtgagtagtgcaactatgcatcttgcaagaaagcgtgttcagaaatgtggtcatggaaaaatgacatttattagcattcaagtccaatgctctgttaataaaaaatcgatacgactgagtagaatgagtgaagcaagtctcaagaaacaagtactacgtgttgctttttttcttgatcggaacaataactcttggattgcagataagaattttcagggtgaagacagaacgatgttacgtctttggaatgaactctcgacatatcaacagtacttgatatcttcgtgcaacaacgacgttaaaatcctatctgagttgtacggtgaatttagacaaatagctctgccttacgacgagaagttgaacctaaattttatgccggttatcagatcttcttcagaaagattgttcagagctgatgatttgaaatgttcgttctctaggtggctgggcgcagaaggggagtttgcagtttgtgaatattcaggttggggtgtcagcaggctgggaaagatcgaaatctttgcggagaagccactgacgtttgatatggcatggaaaacggtaaagatgagatcgtccggtgcatatacgtctttatttcgcgacgatgtgacgtggggacttattccattggataaatgggtaggggataaatatttctgcatgtgcacgaacaaggagagtggcgataatgttatcgttacgcttccggagaagaatgttgaaaagtctattcagatttatgacgaaggttcggctatgttatcatttgcagagatgacatctatcatattaaaccttatgttcatgggtgcggtggcggtttctgtgggtatcctgggtatttcctgttttgtaggattgaaggaaataatatactttatctttgttagtgttgactacatgtggcctttttgtgatacgttattgactacggcggttaattgtttcttcaaaggccgtacctttcttcgacgtgaattaaaaatttaaaaatgataactgtctttgtcgcatgcttatttcaatgcgtttcttcgttgccggctaaactttacatcaagactactctggctgaaagaatcggtaaacttcagaccgttattggcattgataatgatatagtttttgcttacgagaggctctatgaagatttgacattgctgaaccatacggttgttggagagacgttgtttgaccttacggggagcttggaagaaggaaaaaattctaccgtagaccgtttcttaggacatgtggtgatacgtgaatttcatagactgcacgctgggcttcagtatgtctctcttcgaaatttttctgtaagcgaattggtttgcttcgttaacaataatacgcagttgtctggcagctacgtttttttagcgggtaatacaacctatgtacagatagatctgtttaatgaaaatcgtggttttgttcacgatcttataaatttgagcagttttttacaaaatcggtctttgcacgtattgtcgttttatgcaagacgtttttgtgtagaagacatcttaaatttctatggtaaggttgttttcggggactctagacatcgtcctccgcaagttttcagcaagagagatacaggtttgctcgtttgtacagctcggcgatatcggcccattggaacgaatattcaatggagtattcaaaaccagacagtttcagatgatcatatgactgacgatttcattagaaccgaaattgccggtcaacttctatactcttatgaaagagcattgagtagagctttgagcatgacacaacgtaatttttcatgtgaaattacgcataaattattagttaccccagctctcttaacaagagaggatgcttttagttttaaaggttttgtgaatcccgtgaagcaatccgaagacatgtttccacgtcataattttccagcaccgcacagaaaaaaatttaataaattgcagctgctgtggatttttactgtgataccaattgctgctgggtgtatgtttgtatatatgttaacgcggtatattctgttttttgtttctgggggatgttcattgaatccaaatagggtgctaaaaaggcgtaggagaaatgatgaagtgcctatggtgattatggaagtggaatactgcaattacgaagctgatgattacatggaactccatagcgttcaaaaggtccgtgacaattcgatagcggttgtctgcggaaataattcgtttgatatagaacgacagtctaaaatctcacgaaatttttagcaatgtgaagttagaaattttacctttggaaaatatttccatgactgtgaggttatttgaatagagatttttttaataaattggttttttttaacagtgtctgtttttttcttaaggtgcttttaaaattatgccacacccatttccggagttgcagtgtgtttttttcgtataaatttaactaagattgtgcagttattacatttttggatggccggttacaatagtcattaacgagaaaaacatcgtaatggcattcaccggtgatgaactggcgcgcatgttgcagtttaaggataagatgatttcttcggcggggctcgctctgaaatttgagaaagttgtacaggaggctatggcttccggaatagttcttcaacatatcacttgtattaaagttcggatttgtgacaattccgatatcttgtctgaccgtcagctgagaagtttattaataaacgggttgtatccttttgagggtaggatgagtatgtttggtgtaacggaggaatgggaaggtgcgtctgcggctccggagagacaggttgtttttttgttatcgtcaactggtcaagtgcttggatatgaagatggtgtggtattttatttgtcacctacgttttcagatttttggacaactgccatggagttctcgtgtcagaacgcgatcttgagtaattttatcgcacagaagtcccgcgatgaatacattgatcaatttcaaaaatattttacgagaatgagacatactccaattttcttgacaggtgtattgcctagacggtttcagaaggtagagagcagtgcttgtgtggaagaagatgctcgtgcttccatgagaccaattcagtgtgactcttttggtgttaaggatacattttgtcggccgacggaagaattgctgcagccatctgcgaataaagatgttggtggcaaggtgtgtatgtctttatcgtgtcgagaagacaactccgctcgacattgcacaatctatggactgaccgaaactcgtggtataaaaattatgttctcgaggcatacacagacagaccggtctgaggtgatgtgtaacgctgccacccaaaccggagacgtggtggataattcttcagaaactctgtttctcggtaaaaatttggtccatcagtcaattttggaaacggaagtcaaaacgaccgcaaaaaatacttttgatgtctctaatcctcgaatcgattcggtgtacgatacgacagtgttcggtgctatggcaaccgatgatgtaggttgtgaaaatgttcagggcggtgcgtctttggcgcaagaaaaacctttaaaaggttattgtatcactgctactccatcagaatgcaaaccgaacattcattggcttaagagcccagaaaaaactgttcaggaatcggcagctgtgctgaggtaggtcttttaattgtttcacggatggagagagcgtgcacacaaacagtaattttagggatggtggatgttttcgcttgatgcatgtggcaattgctggtacaagagtgcacgaaggtgggttatagatgactgaattgcgttaccgtgtctttaatgggtttgttttctacattttcaaatttatttgttttgttgtattccacagagacgcggcagattttttggaagaaattgcaaacgatttgtaaatactaaatgttatgaagaagttaactatggagtccttgtcagtttatatcttcgtaatgggagtctgctttacatcgaatttcacatgcgagcaaaaaatagtcttaattcaggaacataaacttagatctatatgcatctctacttgttatgtgaatggagtgttagctgggaattctagctgtgtttctgtcaaaacttcatatctgatcaaccttgcgatgttaacaaatggctttaaagccatgagagttggaaatattacatctatctctgaaaaaacggcttttctgcgtgtgattattaattattattttagaggagtgatgcttagagctttgatcgctcaaaggcttccaaatgccgctaatttatcgagtactgtaaattgctggctggatgatcatagcgcaggaggtgtgatgactctattttatggaacggaacggattgttctcaattccagcactgaaatcaatgcgagtcgatggataagtgacgggcaggatgccaatggcactttgaacattttaaatgagagagtgtctttggatatctattttctgagcaagatctgtcctcagttgtcgtctgaaatttacaagaaaaaggttgcgcatccgaaatatttttcattaatcaaaaatgatacgaagccgaaaaaattcttaagaaatacatggaggtctgcatggagtaattggtataaatataaggagatcaaagagtttttggatttttcaagcgattacgagaatttctctgaaattacgtattcaatgtcggctgctgggttgttctttttggccgggggtgcatttacgatgctgttattgctatgctgtttgtcaatgattacgcggaaacatattgtgaaagatttaggatattaatgtttattaaaataattacattaaaacaatggaaaaggtggtcgtagacagtaaaatgtgtagtggtcgttggattaaatcatatctgcggaaataaaaaatattaattacctatagtcaatgttgttgtttttttgtcgggaaataaaaaatattaattacatatagtcaatgttgtcgtttttttgtcggatttaaaatggattagtgaaaagacttactcacctgcgtcaatgcgtatttgatagagaagcgcggatagcgttcattcccagtgtcgttagaatgtggattagtgggacctataaaaaatttcaaactggtgtaaataccctggggtgttcgtaatgtgcagatcagtcaaaatctgagctctcctgggcattagtgtataacgaaacgataaaagtacttactattttgttttgtcgatgggaattacggatccgactactgtagttttcaggtaagaagtctgcctatggaaatgatttaacagtgcttaaataaatatcgcgtttctatcggtaaaattgtatatacgtttttaatatttcttaccatttcaatgtcagtatcattcgatggctgccgcttatggatctgtctatcttgagaggtaatctctggattgttccttccgttggaatagatgaagaaaaagttgatgtttaaggcgatcatggttgtaatggtggcagcgatttgctgctctttttgatcttcggaaagtttggtatgtatgaggttttgagggtttgtggctttcttatatataagattttagggaatttttgcatatgacgagtatttgaattttccgcaacggtggtttttatcattcgtttcctttacgggaaatcagttctatgagaataaactaaggatattgttgaatcagtattgtttacattgtattattttacatacataagaatcattattaacgcagggaattgttcggttgtctttgttttttccatgggtggacgagatggtagttctagttcaacactatgacatttcttgtttttggatggtagttgattaagttgagttttttatctctgtgtggtataaaagatggataagaaatgcgagctggtttatttgtagtttcgggttcaaaggggtagttgacggttccataacgtagatatggcagacgaacgaaccagcgattctgttaaaactcgttatgatattgcactgatgaagctaaacgatataaaaattgcagtttttcgtgattctctatcgacatacgtagaacagaagaccggcttaactatacagtttaattggccgaaaagtcgatgcttggtgatttcgacactgtgtaaaattccatttcccacaaagtctgccgcagagttgcaagaaatgtgtaagtatcagtgtttcgtgtcagttctgtggtgtgtcattctcgtttttgttgtgaaaataaagttatttttccttttaaacaaggttcgttattactttgctgcccggaaagattgcaactacttggatatgtttctgtctggggagaggagactcgtgatgtgtgcctaactaaaacgttggtgtttgcgggagaagacgaaaaattttacggtctcgattttgtgaatgagacactgtatctgttggcggaaacgacggaacgatttgcagttctcggattgcgtcgctatgatccggtatatcgagaaaaggacattcgctttctaacgaaaattgatgatgttcttcaatcgttgattgatgcgcaggataatttatggaaattcgctactatcgtttataaaaatagtgggaggcattacattatgaagtcttgcttggaaaataacgatggagtatttgttttatttcttactaggaaagaagattttcctagtaggatggaatggaatttcttttcggatgtctacgagagtatgccgtatgacgggcaggttatcggaagcattggaaaaacattactgtatcctaaaacgatgtttgtgatgatggatttatcgggggcaatttatggtattgatacgatcggaacgggaattggatcttgtgttaaaatagcagacgattttgaatcttttttaagacaagggattgttaggggatatcgtcgctataaatttttccataggaacattaacaccgtccaagaaattttgccgttgtgtccccatacttctctagggcccacattctcgaataattacatttatgatttatcatctgaggatgacgagtaaatagatacgtcatactttgagttgtatttaacttgatgtatggagatgttagtatacagaataaaaattttagccgatgataatatttgtcgttgtagtttttaaatcctgttttgtaccattgtatatgtgttatgaatgagatgttctaaaggatgggcaagtagccaatgattcttaattcttaaagcgtgtgattcagtatctgtttttataatacggagagctatcgtgctgagcggaacagagctttggctgtgacgaagatggatgtgtggaagcgtcaacggcttcaagaatgccgtgaattgtgtcctttgcctgtattaatgtcactgtcgaatatgttttcaaaaatcgaaatcgtatacgttaaatatctatttaaaatggacttttctactatgtatagatatattttaccggctcttacgttgagtatgacggttacaaaatccctagttattgaaatgttatttattttaaaaagatgggaagatattgatcaattttttagattgaacatccggaaagtaaacgactgtttcatcgtagctcagttcaaccatattcctataaaaaggtgggtactgatttaagtatacgtggaagcgagcgggctaatgtatgccgattaatgtgtttttcttttacaggaagttaattgtgttgttgtatatgttaaccagtagacaagaaaaacagcttttcctcaatatgatatatgcggtgagtttgattttgtacagtagatttcaagatatattaaattgtaattaggtgcttggtccattaggttgctagactatacttttctggtggtaatttagtgtttaatgtaaagttatattggattggatggataaaattgatggtttgtgtttttttttttagtttttagagaagagtcaccttagacttggtgatgatgaagaacagaatgctattcgttttttttcttacgttgatgatttacacctaacgcgggatattttattggagatgatccacaagctcaagaatacggaaatcaatcaaacaatggaacttttattatcgtacaatgaattggctagataaagcactttttacagttaataaaattatttgtgattataacctttcgtcgttcgtttccgttgagcgtctggttctgcgtctgaggcgggcattattttgtcctcttgccggagatggtggggccattgtgggcgtacgtcttctttgttcgttttgtagagctcggcttcgacgagacatggagttgttagatgatgctgattgaggggagtgtggatggtcctccatgggttcttcgtcttctaaatctagatctgccatgggatatgaataatcactgatatttgtttcgtcagagtaatgactacgattatcgtcgtcttgtgagaaagagaccgatgatgatctgctgttggaacgtattggtgctctttgccttaggatagaagttggagtggagcgaccgctttgcgggggggagtatgggatggtagaagtactgtggctggaggatgcacgagaagaggcccgtccttcattttgatttaaccttttgatgacttgtggtaggcttaagccgtatttgtttgcaactgctccgtagacaactgctgagaggctctgcatctcaacttctaggacttgaattacattttcttccacatctatgatcttatcataagaaattggcatgatcgctatagacgagaaagcattatctgcggttacgttaaaaaagttagaatctgtaagcacgttgtctactctgcctggatcgacttgtattggtagtttgtcttcgtcgtattcatcatcagaatcgttagatttcagaagcagataattgaggtcttcatcatcattgcttctttttaagacatcctcgaactctattaggtgactctttatgaaggttggtaaaatgcaaatatttgccttagtcgcgaaaatagagatttcaaaaagtttttccagtatgagcttgtagtgagaaaaaaggtctttatctgggtcgacgagattcatatttgatgtgagtgccgctagatctagtattgtgtcctttagatctggaagttggaatcccaccaatacgcaatcttcgactatggagttgatttcgtatttgatccaagtggtcaaacgcctgatttgtactttgcagttataaatcatattccaagtagaagttaagaatagcatgtcgttaaaaatatgagataaatacccgtcgtctgaagaagtaaacagtaatgtgggctttttattaactccaatagagagatctttaagattttcggaataaacgtcaacagcttctttcaaagtataatggggtattttatagaggtaattgtatgctcgtaatttttgtgcatactgttcgatatctgcgtccggtcgattatgaaaggagtttaaggttgtgtttattaatttgacggcttttgtgaatttggaatctggaaggccgttttcgtgcaaggacaaggctatgagaggcatatatgaactaccacgagcatcgacaaacagccccataagagctctgtcgagacgtcgcatggcttcttcggtgtcgaaaagacttttcatcattgtaatcatatgtttgacttgtttttttccggcataaaatctgtttatatgtacgccgaggcggagtactttttcgaacagatctcgtgcacgtgaaaacttaaactttgtgatgataaccataatttgctctgcggtttgaatcgtcatgggaataaagctgtttgcgagacaaaccgtattgtaggagtcttggatgagtacatctttgatatatttagcgttggcgcgtgagagaacttcgggtatgaagttacaattttcgtctaagacgaaagttggaatgttgaatgtctttggttcttccatcgcgtgtgtgaccattggtgtgatttcaaccaccttaaatatttcatacgggatgtatcaacgcgagacatatgaaaaaaaaaactgtgacgtgagatcatgaaaaaaatttttataagaaaggtgatagggtgcaattatgttccgagtcacataataagaaatctggatcgatagggtagacgatagctttttcgttgttgtctcctataccgtaaaattcaaagaggacagttttgtctaaaatcacagacaggggcgatattttttttgaatccgtctgtgttttgcttgcgatataatcatgttctcttgaaatgatttcagcgtctgcaatcttacttgtcgggcgcatggtaaaagtgttggacaatatggggtcgtctgtcgaagttaaaagttttcgtcgtacccgttttttagcgtgcgccatgctctatggaagataaaacacagaaaaagatagtacgtgatttcatgtgggtagcatttattagttaaaaatttgtaaaacgtgtttaaaggggttggtttttttccactgacgcttttgattttgagttctgatcatgttcggatgcgtctgaatccttgcgtttctgtgtactacataatgttttgggaaaaaatgattgaaaacaggcggtaaatcggtttctgagttcgcctccagtgaatgcgtagactaacgggttagagaaacaatgtacctgtggcattaatcgaatgattaactgcagtatctctacacgggctaaccaaaagcaggtgttctgcggcatgtagagaaatgcgatttcacatataaggatagctatataggggatctgtatgagtaaaaatgacaggagaaggattctaataaaaaatagagtctttttgtattttttctcggtgacgtcgtgcaaagctttgcaaaatataacgtagaagaagctgaataccatggttggaaggactccccaaatgaagctgaagacaattttcaccgctagaaacagttcgtaagctttctttgaggatatataaacgacgcattttcccgtttttttcattccgttagtcttcacaaagagagcggtaggaatcgcgcacattgaggaagctagtaggagaattcctatgtttcgccccgtgctagatgttttactttcagtctttttacgccggtgtaaggttttgtacctgatagttgcgattatagctagcatgcttatactatatgaacagactgcatgatagatgaagtaaactaactgacagaaaaaacggttgaatgagaacagttgctttctgttcactgtcataaaaaagacacaccacatgagcacaaaatcgctagcaaagagtgtgatgacgtaaaatgaagtagcgttatgttttgcgactctgtggtagagaatcatggtggtaaccactataatgatcatggggatagatgtggtgagcgtgattccggtaactgcgctctccatgattcgtgctgtctttagcgtgggtgtcgaggtacaggaagcattgcctttgaactcttcattgcgctattaaagatattgaatgttattttcatgttacgctacattaaaatattcggtaacaatgatgtctgaagacttaccagaagtttggacagctcaatgacagtgtccatctcgtcgcttgtcagttttctgtgtgggtaaaaaaaagactattaaacattgaatgttggcggaaatgagcagttctgtttttgagtttgttttctaaaatatggatctgcaaagacatccgattccgtttgcgtggctagatcgagacaaagttgagcgtcttacagattttctcagcaatttggaaagactggataatgtagatttgcgagagcatccccatgtgactaattcttgtgtcgtgagagagggagacgatgtagacgatttaaaaacattgtataacctactagtgttatggcttatgtatcactacgtcttatctaaaaggaagccggattataatgctatatggcaagacatcacgaaactccaaagtgtcgtaaacgagtacttaaactccaaaggtctgaataaaggaatttttgaaaatatgttcacgaacaaagaaaagtttgaatcgcaattcagtgatattaatcgcgctttactgcgtttaggaaactttattaagtggggtagcaatgttgcgatcgatactccttatgtaaatcttactgcagaagacagcagcgagatagaaaataatttgcaagatgctgaaaaaaacatgctgtggtataccgtctataacataaatgacccctgggacgaaaacggttacttaataacgagtattaataaattaatttatctcggtaagttatttttagcgttaactcagtcctggtcaaagctagaaaaggttgctatgagtcaaattgtaatcacgcaaaatcatctctcgggtcatttgaggaggcacgacaattttaatattgtatattctcatagggttttgcagactcctctgactggtcaaagagtagagagttttctgaaaataatcaccagtgattatgatattatcaaaagtagtctggaatcacacagcgcgtcgaaagcattttcgatgtctgagattgggcctaattctttaatggatttcgtccctttacgcggcgatatacattcaaatttgactttacctagtatgtctatagatacaaagaaatcatctttagatccggctcgtctgaaaaaaagtaattccagaagtttggatagtttcttaagaatgcagagacaacctaaatttctagagttggatagcgttgataatgccggggaaaaaattttactaaaggaagcaacactcgggggtgaaaacgttaaagcgacaacgcctgcttcctctgtctctttaatgtccggagttgagtcgccgtcgtctttcacttctaccaatctggatctgccgttgtcgtctttcacttctactaatctggatctgcgagataagtcgcacggtaattataaaattggcccttcggggattttagattttaatgttaaatttccacctaatgcgcaattgaatacgaacggtgtggatttactacaggataaaacttcgatcgggagtcccagtagcggtattaccgatgtggtaaatggtttcgctaatctcaatctgcatcagaataaatcaaatgtttcgccaccgtggagcagaaacacagcggcgaatgcggactttttagatccggtgcatcgctttgttcctgagcagacagggacacccttcgtgttgaataattccgacgtggcgggatcagaagcgaagcatacgacttacagtacggagaccggcgtttcaccccgtaacgtttttctcattaaagatttgagaggcaaagacggttttaggaaacagaagcagtcagatattccgaaaagcttaactaaggaaagaaatgataaagctataatgcactcacgcgaggtgaccggagattctggcgatgcgactgaaactgtgggtgctcggaattccccggcgttgagaaaaattaagcaagcaaatgatttttttgccgggttaaataagaaaaatgatcgtgacgtattaagaggggggaaaggaaatagcaaggacttgcattctggcggcaatgcaaaaaaaaaagaaatgtcgggaaagtttaatgacgataaagaaatgacgcgaaacggacaagagccatcacgtagtttaatgggagatgctagaaatgccggagatgaacaatatattcaagcgggtctcgggcagcgagttaacaatcttctaagtcaatttacaaatctgattagtttaggcgagaagggcatcgaagacattttgcagaatcagcgcgggaccgagttaaagttggctacagaaaacaagtcgggacgcgaatcggaggaagctaacgtagaaaaaattcttgaagttagtaatcctcaagatatgtttaaaaattttaggttgcaaaacgatctcgattccgttcagtctccgtttaggctaccggatgctgatttgtctcgcgagttagattccgcgtcatttaaggacgcgttagacttgaagcttccgggtaacggagaacgagaaatagatctcgctcttgaaaaagtgaaggtaggcgagacggaaacctcagatttaaaagtcggtcaggatgaaagttttgttcctgcgcaattaatgaaggttgagacacctgaagaaaaagatgatataattgaacagatggttctgaggatacgtcaagacggggaaactgatgaaaacaccgtctctgggccgggagtcgctgagtctttggatatagaagccaaaggcgagtcagcgatcgcgtcgtgatgtaaaaaattttctctggggagtttcaggttgccaataaaatgcccattctcagacagctttgcgattacgtctttttgtgctttgaggcaggatcagatttggagaaaatgaacgcagcgtaatgtgcaaaggtgttcccggggcccacagcatcacctgggtttcgaagaatccttcgttctggtagccggatatgaggatttgcttgtcgggctttgtgaaatatcggataggtagaattactatgtggcatcggcttggatagaaatggatgtcatatggtgcgtgtacaagtagctcgtaataatttgggttgtgttgcagttgtatcgttgcgtttagtacgtctcctgtaaaatataatttcgggttactggaaaataacagcggttcgggctcttcgatttgcgttaccacttcaaactgaactattaaatatttcggtagattttccgttgttagtaaagaagggatttgctcgcagcatacagtggctagtgttccaaaaactttttctttgtttttgacgagaccgagattttcaatgttaatcgagaattcgtggcagtgtattgtaaacctagtgttattaaagaaacgcagtgccactctgtcaggtagggaggtgtccggccaacttcctatgaacgaagcttttaggattctatgtggagccgtctgacctgtgccggtgacgctttttttccacgtaagatttttgatgactcccaggtagaggtagtttctctgttttaaaatctgtatatctccgcattcgtgttccggaaattgttcgtttagtatcatcaggtcgattgatgatatgaagcgagcatagtttagtgggtatttgtacggcacgaacggcaccattaatatgttcgcagacattccggttagcgaaaagtttgatctgtaatcaacgggatacgaaaaactccccgagatccaacctccctttgttatagttggattaaatgcgatgttttcttcttctggagaggcgattaaaaagtaaagttctttgggggtaaagagtttagggagtgtgatgctagtccagctgtagatacgttgtcgtacgtgtatctgacgaccaagtacctggtgtccgagatctagaattagggcagcgacttcaatcttccctttgtcgaaacgtattgatttatttggcgggacgaggcaatgctcatattgttttataaggcagtgtaggagaccggtgtagaagcgtaggggtttcctgatattatcttgattccgtttttgaatcgaagctatagctcgtccgaatcccgatgaccaggtgacggtcggagatctcgctgaaaccgtcttgtatgtgactatttccatctgtttttagtggtgtttcgagttcgttttctctgaagtggatctgccgatatggctgttagaaagttatggaagacagtcgtacagctgttttctaaatcgaaatccgaggagtgcaatacagaagccggaacgatggaggtttccttcttaaagtacggagtgcgaggtttgaatgcggattgcagctacgtcaaatcgcaatgtataaaactttcggaatgcgagtgtttatatactttcgcttctgatgtatgtaaggaagattttcataattccgaggaaatgaaggtgtttgttgttcaacattcgcaagaaatggtcgatggaacggatttatttgtacatgcggaggaaagcgtgtgagtcaaaacggaggctgaaatttaataaagtttgtcacaccactctgtttttttgcaatttcctgtcatgtgacggcgtctcgtatccaggtcttatatttcagatacctcattgtttcacttctagtgttattcggagttttcaagatggacctcgaggcgaaggagatttcaggtaatattccgaacgagaacgctcttgccgaattgtgccgtttatgcgaatctgccgatctctctcagatcgagaattttgtcggcaggtataagaactggtgtctgtctattatctggcctcggaactgctggctgagattcactccgcgtaaagatgtagctggatatacggaaaagatgtttgaagatatggatgatcactatcagggttttgtggaaaaactgtgtctactggggactattcagattccttacagagatgttccaattctgattggtcgatctaaaagaattttcttgcacgatttagagacggatactctccactttgtgtgtgataattttgagcaatttgtgagatacggcgtcctgggtactaatatcatcacatgcgcggagcctgtgtaccgtcatggcttgtatgaaggccccagattcgaatcgcttgaaaacttaatgaataatgatgtgttaaggagtccctatactctaaatgtccatgtgaagttgaatagaaaaggcgttttgggcatcaaggctatgaggaaacattacattgccatgttgcgggagtttgatgagcttgcccgttgtgccagtttggacgatgtgggacgtttcgtgtctctcaacgtcggccgagatcttagattggatatgccggtttttaagagtttgaccctagggactcgtgacagtgtctggacagggacatgtcgtttggcaaatctaaaagaacaggaagacttagtagaaaaagtagtagtgttaggttacctgaatgaccatgattacgagtctaaatgtacaagacctattctttgtattgggaaatctggaaaaatatattattacgattggatagacaacgtgctggttaagctgggcgattgtctacttacttttttgcgcgtggggtttgccagactttttgcggactacggttatgagaagattggaaaaatctccatgcgcttcggacggatgtcgacgttgggcatgtcggaaacttatcaatcgtgcatgagtctcagtaagtagttcgtgtgaaatttttgactgatacttgaaacggagggcggagagcgagtcttgtgtgaaagtattttactttattctgtgtttatgtttcaaacagagatcgtaccggtctgcaacgacgagttcgccttgtcatcatgtgtgcctactttggattttgatgtggacgttctgtctgcagcttacggagacgggttggaaatcagttctccgggcttgcgatgttgtatcgcctggcctcccatgtatgcattaaccctgggtgagttttatcactttcacacgcataggtgggtcagtgcttatgactggagcagtctgctggatgctgatgaatttatgtccgctgttgggtatgctcacccgatatatcgtgatccaaatcctgactacgatccatacgtgatgcatacttcaaccggaaagaccattgccgtggacacggtgacggagaaagtgtacatcatagcagaatcattggttcagttcttcaatattggacttagacaatttccgccttttgccgaagcggagttagatccagagcaggaaaagatgtggttcggagagactaaatgcggccgggaggaatttatccttttacagaggaatctccctgctatgaaggattacgtggcaaaacattccggcaagagaatcagggtggatgctttccaggactttgacttttccttttgttccttgtcggatatttattatctgactggacctggcattctagagaaaatcacagaaaaggattatgctatcatagggacgtgtgcccgttctcaggctgaaccgaattgcagagctgctatcgttatgggctcgaactgtcacatttatatctacgtagaaaacaaaatcagcaaagtctctaaaagtttgaggactttcatacgtagaggatttgatgagttgctctataaagagaagtattcgttggattggagtgacgacaccttattttatataagtgacactgagacggagaatctcaataggatgttgaatggggagttgcccgttctccgtagtaagcctcggcatatgtgcgtgcgaaaggacaggtgggtggatgtgttctgtgtcgttttccagagaggataattattcgaggatggagactccccgctaacttttttttttcttacaacaggcttgtgaaagaccgtagcaaaattctgtttgcggtgcgtctggatgaagaggattcaccgacggttaaatttatcacaaaatttctcacgccggtattcgtcggtcgactgcccgctaccaacaggtttgttgttcccgtctcccgcgccaggttgacgaacggtctgcaggggaccgcagcagctagatttggcattaaaggactacatccctcttcggactgcttggtgtggaacatactggtggattatgagtatgaaacttacaagtatccttccacctacatcagagccgatcagattgcggacatggtgaaagacttaaaatttatggacaattttaatgagaagtggcagtgcatcactaaactggcttttctcggtctctatgccggagcgtctctgtttaacttcacgtccaaaccaacgctgggctactggtgtcgttatctaagtgagtatgcctccatgttattatttcagtttgaaagcaagttaaaagagttgaccaaggaatctactcggcaactgggaggttataatctttgtcattggggtcaagaattgaaggactgcttggaaaacaaatccgatgttttcttcaggtacgatttcttcgagcgtatcgaatcctgtcttatcgaacactttatgctcctctgtggttgtgtcgagtgtaggcgcatgttcatcatgtataacaagagaggtaggaagtttgattttggccacagtgtccgaatccagtgttttcctatgataggttcaattcgccttccggcttttctgcatcttggtgaaccctacgatgtgagtctgtcgagtctcatagcgaaggatttagggttgagcatgatcgaaggtcagatagagctcagtaggctgcctatttcgctccagatctctgtcactccggataagaaggcattgctaaccttcttaactaatattgtcttcattgtcttcgttgtgaacaccctctaccgtgtcataaatgctgagttggacatatattacgacctcttcacggaggaagtggggaaattgtgtgtggccatggaggaagagatgaagctagggcggaatgggtgtctgggagacctgtgttacttttctccgatgaaacagatgaaagaaattgttaggtgtcccggggaaaagagtcagtttatcttaaagtgttgggaagctctgagaatcggtttttccgttcctgcctacaaagattacgatgagactccgttcatggaaatgttttttatgcatcatcttcatataaaacgctttcacgaggacaatgatcgtgacctggtgtcttgtgataatctcattccggggttttttatcgttaataccgatggagagaatttcttacagcggctacaacgggtagtgttgcccgtcgtcgaagattatttaactaacaccaggtgcataaacgggactatggctttttttttcagtggcttgaaatattttgggagtggcaatcatcgcggttttcaaataagtcccgagaaagacgtcagagctatcgcatataaattggggtcgttggacgtcctcagggatgattacaagtattatgaatacacgccaccggattgtcccggcgaactgaatggacatggtggggatgagtgattgtgtgctttctcgattgtgatgtacgtggccgtctgttgtaatttgaattctgctcctttatctttatttttccgcgacggaaaataaacgctgtctcggatatatacttacttgagtgatggagttattggaccacgacatttataagggacccgtccgagaacgggtcacgtataccattcccaaccatccctatctctcgcttaccgttcatcattccagggaacttgatgttgatctgaaagacataacggaggagatgattatagatagcggcacgttgaccgcagaggatctgtttatgacccgcggcttacgattttgtgacgatagtgttctctgggcggctctggcggagaaagtttctgttgaattccagaggcgtggaaagacgaccatggatctctcggcttttatgtctctcttagaacggttaacttttgaggacgaaacgtcagttttttatcgactcctgaccaagtgcaccgcgctggcgcacttctcgattctggagtacatcgtcgatggggagaagagggatactatctcggcgcattttaaccgtcttttggagttgttggactccctcttcctgcagttcctcatgttgaggaacaggagcgagtccaatactctgttgaccctgttcgatattttgcccaatcccaaggagatctatggcgacgcggcgtctccgacgagtgtgctcttgaaacactttttgtccgatcacatctttgtcgcgtacgcttcttcttatcgctttgtgtcttctgtgctctgtagttgcgatcagtgccgggcgtctctctttcggatctatctgggtaagaaagattcccgggccgtgcacatatccgatatttcagaattcgatccggctgatctcattttaggccagctgcacctcgacgcgcgtgaggcggtcgctctccgggcggagatcgaccgagatctcggctcttctctcatccttaactctatggaaaggcggcatttgcccattcttcatgataagcagttggggagagggcattttgaacgtaacatcttgaaggtgtactgcaacatcgttctgtgtctgtttctactgagacgcgtcaaacagcgcatcgtgagtgatctcactgccattgctcgtttcttcgtaaaagcgatctccgaaatggagcgttgcatcgataccgtttctggcctccgcggtgtcaggatcaaactgttagttgtcagttctcagttcgagattaaagatcccatgcgcgtccctaggttgtgttttttctttcttgagatcgtggcgattctcgtatcgggttatgacaaggaacggcatcgcgttcgtgctctcttagagcatctgtgccttaaaaagatctgtctcggcgacctgtgtgcatccatgcgactcgctcgcgagataaggcacgacgtcctggagggcttcctcaatactctggagttatcttacatgtcgaatccggttaggttttttcgttttcacgactgcaacctttacgggacccatatgtggagtggggtgtatccgaacgtcgttccttacgctgtgcgcggcggcggctcgtttgacatcaggctgcaggagcaccggagacgtcagaagcgaatagtcgtcagacgtaggcttataagacgcgtgcagcaacgagggttagacattcgtgaagcgcgccgcgttcctaagccggcttgtgtgacctttatctgatacggacgaatccggaaaaccggtacgcttttactgattagttttcacaaagaaaaaacgatattattgttgtcgtgatcatccatatcgttgttcttgggtgtgcattgtgacagaattcttctgtgactatattatctttcatttttttgcaacttttgcttagtctgtaagttttgggtgctatttctgttactgcgagcccgtaatggaaacgacaaagaaccggcgtgtgcgatttactggaggccttcatgagccagcgcaagattctacgatgtgtgggaatgctgagctgcagtctcgggagaggaccaagacacgtcaacgtgtctataacgagtcgaagagagatctcgtagatctcctgcgcgtctatacgtgcctgaatagcgttcgaatgtttacgttcgtaaatttcggcaggcggattcctttggcttggcctgaaggataccagctggtcatcaataactgtagagacgagaatgaatatgccgatgaaaagttggacgaactggccggtctggtgtgttgcccggagcgcctcgtcgtactgggatacgtgaagaaaagggggggaatcggatcggagccgtgttactggttttcgaaaggtgacatagtcgttctgctcggcggcgccggtcgtgtttatgcgcacacgtggttattgccgcagcaactgtgccgcgtcggtgacaccattgacgattttctacgtaaaggtctgaagaggttctattacgcacatcagctggtgtcatcgctgcagtttgtggtggaggaccccgaggtggacggcgtccgcagttgtcgggacgtgctgtgttttcgagaccggcacataggtcgttctttcgccctgaggtggcccaagaacgagactctgctctttcatcggcggcgggattcttttgccttcgtcatgtgcgacgaggcgcggcgcaggctcgcggagatgtgtttcttcggcagcttcggatacaagtactttggggacgaaggtcggatttctctctacgtggccgacgacggccagattttcggatttaacgacaacgacgaagacggacggccgcgcttcgttgcggaagattttcagcagtttagacggataggagtcactcagtattataagagctacgttttccgtagggagcaacccgaatgggcgcttcttcctacctgtcatctatcgcgaatgttttatcagaaaacttggaggcaagccgacgctgatgtgctgtttttaatagctaggaacgacgagcgcaataaatttccggacgctggtactaggagtgccgtacacgacgtggttcgatgattcgcccgaatgtgggtggttgagtaaaaaaaaaaaaataaagagaatggaaacgcgatagatcgagtttttacgggtgattctaacgtctgggatcgttgtatattttacccggggatgtgttcacagttttgcgagcggacggtttatttttatattcgtggataacgtcgggaatgtgtcagttcaacgctgtcttttttccctaacagtcgtagtatccttaacgcgatcgtagacgtttatgcgagactgccggtaacgctgtcgttatcgttatattttttatttttgttttccatttttaattttatctcggattccgcacagaaaataaaatgttttgtggctctccgtttctcggcatatcttcttggagtctggcatctgcggctctgtgtcctccttcgtgctctttctctgcgggacgtgacctgcggtgcgatgcggaggtcccggaggttaaatggacggcgttcgttcgcactctcgtcacccggccgctgtcggcggacgacgtgtgggacttcgtctctacttttgcacattgcaggttggcgctctcgtggcccgtgggggccgaactgaggttcgccacctccgacatgctcgggatcacgcaggccgaggtggccaagctgtctcgccgatacggatgctgtcccggtatggatctcacggtcatcggggtcactatcttcgcagaagtttccgcgctggtgctggtcggagagtgcggggagatctacgcgtttaacggtgtgttcgacgacgcgctgtatcgtctcgccgaggacgcgttcggtctctggaaacacggcctgcgtcgcttcgagcccgtctacggttccaagtgtctcaccgaaaccggcgcctctttcttcggcggcatgagtggagttgacgacgtcctggctttcgccgtgtctttcgataaggctctcgtgccgttgccttggccgcgcggggctttctttgagttcgccgtacccgggaggccggagaagaggtggcggctcatacccggcggcggcgtcgcggtggtgatcggcagattcttcggacggggcgtcacttcacctctgcttagacgacaacgggtgctcatggatcaggtcggcagggtgtacgcggccagtctcgacgggggagccgtggtgcgtctctccgatagtttcagggcgtttctcgccatgggtgtgagaaaactctttaagaaccatcgattccccccgggacatctgtggaccatgcagctgcccgtgacttgcgttcacgcgcctgtgatagatctgcccgccgtctatcaactttctccgcacatggtagaacgaggaatgcccgtggcgtcttgcgaagcttctaccgtagttcgtggggattgcgaggagacggagacggaggagtcgacatccggtgattccgtcctcgtctgttaatgtagttgatgtagttaatgctgctgctgtggttgttgttattgttgttgttattgttgttgttttatgttaacatcgtgataacaatgcatacataaattattttttttcgccgtgtgtgtaatttttttgcgtgtgtgtatttttttgttgttgtttttttttttcgcgcgcgtgtgtgttttcgctcacgtggcagtctgctcggtgggggcgcgtcggcgtgtctgtgtacgttcgcgcgcgtgtttgcatcagtgacacgggtcgggggtctgcaaaaatgtctgcggaaaggtcaaccgcccggcggggcgtctctacgcgcgtccgctctacaccctctctcgcgcgcgcgggccctcctcgggaacgaccgcggccgttctctctcctccggcgtatcctcgtctgccctctgcggctctgcctcccgtctctctctctctctccttctctcgccggcgccatcggttcttcgcgctcaccctcgcctttaaactacgcgccgtccgcccctataccgtcgtccgctctttcggggggtgcgggggggggctcgcgcatccacgacacgcgtgtcttccgcgcgcggcgactcgggccgcaaccaatggggagtttttttcacgcgtctcgcagcggcgcgcgtgttggtgaaaaacacggcgcctcccatagcggcgtgcgcgcgcgcgttgggggatgggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagggttagccggtggtttcctttggcaccgtgccaggccaccgtgggtcccagacggtggcacgtcgcgcgcgatgtcgttttgaattgtcttcacgtctcaccccggtatgccccatctacgtacccacccgcgactaccacatgggtgggttgtgcgtgtctgtgtgtctgcgtgtgtacgcgtccgtggtagaaacgcggtgacaacggattacggaggtgaatgttgcggtggttgggacggggagggagtgaagagatgtttcccgtataggtgtttttggaacgtggttttttttttcttacacttgccatgctagcgatcgccctctgtcttcggtccgcgttaccgtgtcgtgtgtacttccgcatacttttgtctctgcgcctcgatacaccccgttgattggatgatcgccacatgtgtattggacgtcacagtctgctatttttttcactgtctatttttaaacctgttgtcgtcttcccgccaaggctatgtgtctccgccttttcttatatttttctgacgctgttcgttttctacgttcgcctccaatcccggacgcacctcctttgtatgttcactcctcccaccccccggggtgcctatataagaagcgaacgacgcgctttcaagcagtcccgatctatgtgactcaccctgtcgcgttggcatcgggcgctgctatagcgactacgctatagagcggcggtgcatcacggccgacacatacgtttttttggttacctgccatcagtaacacggagcgtaagcaccctgtgtgtgactgtctacgttcgtggattttatttttcgtggggttaaagggaagagggaaggaaaacgagtacgcgcaccgatacgcaccccacgcatacacaccccacacaatgcatgattttctccggtcacgtctctggccgtaggtgacatgcttacttcacctccgtggcgtctaatccaggtacgctctcttcctcggaagctttccactgcggtctcacgtgttcgcacagtggccacgcgtccccggggagatgtctacccggggccgagtacgtccagtgtcctctcatggcccgcggtcccatcttccataaggtggaaaacgagtttgccagacgacagatcttgccggtatcgggccagaacgctaacagaggtcccgccaaagtcaagaccacccaagcgatctccacctcgcgtggccccggcgttggtacgtttcccacagtcgtacgtatcggaggcgacggcttctgcgtctccctctctcgagagagaacgccgcacacgagccacggtcccagggggtggcccgcgtacaggtgccggcggaggtctctccgggcttcgggccataaccggtactgaacctgcggcacggtcagagtcatgcgcgcggccggaaccgccgtccacggatctcccacggtctctagtaagttgcaggacactccggcgtgcgtctgacacaggccgccgacggtcagcaggttgtgttcgtcggcggccgcggcgatcacgtcgaacagatgtcgggcgttcgttccgcacatacgctggtccggcagctctaggtcttcttcatacgtcacggcgtcgcgttgcagccctcgtcttgtaaactccgttgtgctcgacgccagtcggcagagtcttgccgccctcatgtggtggacgtacacggctccgtctttgcccaccaggagcacgcggagcgtgtcgagctgggagttggttacatacgactttacgaaacccacgggttgaagtttctctccgtatccgcaacatacgtacagacaggagtctagggctgtgatgggacgcgcgtacgtcaacgattgaacatgatggatccggccgacacgatagaagaggcgtttaacccaaacaaaacaacaagaaaccataaacgttatggtgggcgttgccttatttttgtctgtggtctctgaccgtataaaaaaagcacagaacatctgcacacgcaaaggcatcccgtggaacgggagatgccgcatacagccgtggtcgctatgcccttgtggagtataacggattcgtatcctgtcgcgtacaattcaaagcgaaaagcacacgcgacaggaatggtgactaatgcgaggatgccataacgcagaaaaaaggaggagctgtaatctttcttttgtgtttttttttaccgttataggagattacaacaaagaggtctcgcgtaaacgagacaggatatccgtaatcaccgtgttccggaagttataccgcctgtaccatcgttaatggaaagtacctctgcggggattcacggataccggattgtggataaaaaaaatcacaaaaaaaatacaataactggactccactccgcgagtcgtctctggggccggaggccgtcatcggctttactgccttacgatccggcgcgtcacatacttgactatgtttcgtctcccctcctcgtattcatactcgttttccgttactcgccgcccctgacgtgacgttttttttttgtccccactctctaccggctggtgtctctggtggttctcgacgaaccttgtactcactcactgtctgaccgacatccctccccgcggctcgcccgtacgtttactcaccgcagtcttgaacgcatctgggtctcacgtgcgtcgctggccaaccccagcggtggccccacacggtggcacttctggcgtctctgtacggatcgtggtggagttctagacaccagcacggcggccacggtaggtggatcagttctccgcgatgccggctcgcatagccgtacagtttggacggcctgccgcgggccaggagcagccagtcgaagcgggcacgggctcgcgcgtgggccagtctcgcctcgttgcgccggaccgagatgcgtccgcccgtcctctgtgtgtgtcgcgtcgacatggctttccgaatgctgtgtgaataacggacgggtttttttttttgcctgttcttctgtccttatgtgggacgggggcctctctttcactatatttatgttatttttttttttaatttgccgcccgcgatgtcgatgtggcaaggtgtttgctggtctgtgacggggaggggtggggagataaacaagaaacaggcaaaacagcacgtatgcgatgtagtcagtgacactgtcgatggtggagcggctcggtaaaaagtgacagacagaacccgtgtcggtggagatatatcataggagcgcggaaataccgcgtgattgaagggtgacggcggaccgcggtgttttctgcggaaccgacgtcgcgacgcccccgggggaaccgcgtctgcggaccccgatgtcaacgggccaatgtgtcgcgtgtcgcatctccgggaatcgccggggacgtcacgtggaaaaatgtttaaccgcgaaaatcacttttacctatgtattttttgtttttttttgtctaccgggtgtggaaggggatgagggcggggagagggcatgaggacgagggcgggcccgagcaaacagtctcgcgataatttgggattgcgcgtcgacttctcgttctttatgcccgcgtacgtcggggtcttgtctcggctttgccgccgcggcagggtctgcgccggcccgtcgcgagctagggacagggggtgtgacggcaactgtgccctgttgcggtttcgcaacgagggggtgcgtcctataggcgcgcgtgggaggggccggacgtatacgaagggtggctcgtctcgaagtcccgcctcatgggcggaacaagggagaccgccctttacgctttcggtttcaggtaccgtcctgtgcttaggtcgcgggctacctgctgtcaggaaggccggattctgccggcgtgtgtccgttcatggatatgtggcatttggcacttacggaaaggggacgtacggagaaggatgagcgtttggccggtgtttagcctttattctgtttttattttataatacactattatattgtatatttttttttattttttatttccacgtactattttttttttatttacaaaaaacctttaactttttgcattcggtactcttttcgtacggcgatgatctcggcgccggtggtacctgtcgtcgcctccccgggtgctccgccacgactaccgtgacggcgacaaccgccgccgccgccgttactgtcgctgttcggagaacgtggccgttacagtttccgctgccgctgcggtcgccgcctctgcggacggagtcggcgtgtgtgctccggggagggggatgggaggggttggaccgaggggacaggggaggagcgttgccgtagaggcgtccgagggactgcccgtcgacgcgcctgcgcgactcgagcgggggtgggagggaaggtggatgggccggcgggcgttcggttgtggtggtgtgttttttttttttattgtcatcggtcgcgtccgtgtgaactggcacgagtgagatgacttgtttttatcggggcggatcgggcgaggggcgcggagcggatccgcccctcgggtgattttacggactggcgtgtggaccgtgctcggggagggcggatagtaggagtgggtcgatcgtttcgtcccgctgggttttccttgttacggtacgcgcgcacacactcccgctaaaaccgggacgtgcacgggctccgttacctccggcggtcgatgtctggcgtgttgtcgtgcgtgctccgcgcgtgtgcgtgcgccggactctgctgctgggtgtgtatgggggcgatatgcggaggttgtcagcggtggtggcggaggcggtgcgcgaggtgggggcgtgtcggacctcgggtccgaagcggcgacggagcccgctgggtatcgcggaagtgcgagaccgagcgggctccatccgccgctcggtccccggcgtgttcccctcattttgttctcgtatcttcttcctcttcgtcttcgtgttcttccgcctgttcttcccgtcctctttcgtcgcctccgtcacctcgcgcggcgtctcacgccgtgtgtgcggcgggcggctgtgacttgccgacgcacgacgcggacggagatgccgatgagggaacggacgtgactctttcggaacgggccggcgcggacgagggcgccggcgggaacgccgcgggatgcccggaggacacccgcggtttcgctcggagtcccggagatctgatgggggggatgaacggagatctgggagacgagggagagacgggagagggcggagacaacggagcgggagagtaggacggggaggaggaggaggaagagaggaagaaacggacacgcgcagtggacggcggggggacgggcggagcggaggggcgcgagacagcggacagcggggtgtcggacgacgggcggggcggacggggacgacacgtggggggttcctccgcgggacctggcggacaccgagggcggacggacggctcgtcgtcgacgggcgtcatcggtggcagaggggaagggaataacagatgagggggagggacccacaggcggggatcgggcccggggacggacagggggatcgacgggcaggaatcatgtcggcctctgccgccgtacgtctgcgtcgcccccccgcagctcctttcgctatcgccctgctccgtttcctcctcgtctcttcttgcgacctggctctcctgtgcgtgctcgtggcgcccggagtcggtctgtttcctttcctcgtgctctccgcgctgctggggctctgttttgtcattcgcgtggcggtgcgcgccgtcatcgcggtgtcctcgtccgctaccgccgcgctggtggtcgtcgctgctctcctggcgcccgtggtggccgtctgtctgttcctcagattcggggcgtgcggagagatggacgcctccggttgccacacgccccttacgcgtcacccgtgtcggacgggtcggtccgcgcgtcgacgtcgcggccgtcgcgctcgccgtcgacgctctccctcttctctcttcctcctcgtaccccggctctccggccgcctcgccgctcccgctcgggggacggagaggaagccggaggcctgagaggaggagcagactccccaggcgacgcagcagctccaggtcgtccgcgatgcgccacacggaggtgtcgttcacgtcaaccgccaggacggggcctccttccgttaggatcagccagacgtgcggagatgtggagagaaacgcgaagggaagccatccgccctctccgcacagttcgtccagcagcggtctgcacctcgcgaagtgttccgcgacgctgggcgcgtctctctgtgcctcatttcgcccgcgtctccagtccgtcaggaccagctctgtgctctcccactccaacacggggtgggagagctccgagcgcgatcccagatgcagtctccacagggcgtagaaagcggccaggccgcgtcgggcgcttctcgccagtaatgtcggcaagaaggccttgtcggggtcccggcacgtccacaggctcggcaggggtcggtcgcgccacagcggtgcgcgatagatggcctcgcagtggcggaggcccgtctttagaaagagcgacacggagtgcgacaggatatagagtcggccttgcagcacgtcgtggcagaacagagaccccccctgcccttgtaggatcacgagccaaggggacgatcctgtcagccagctgagagacggatctgtcgcgtggaagctgctccagcgtgtcgtagccgacacgcgcgtggaacaggcggacagcgtaattaggcccagcggtagcaacttgctgtcggccgaaggatggtagggtttagggtcgaaccctgagggaaaccaaaatgtacccggtgtagtagacaaaacgcaataaatcatgtgaaaaagtggaaatgtatatgacactcacatagagaagacttcgtaggccagccctgaagaagatgcggttgtcttgttatacaggggtaacgcaggagacacttgtaaggcttaggatgtaaatgtaggcattcctgctcgggccaaggtaaaggaatgcgtagacccttgtgcagacgcaggtaggaatgaacatgacgaagggaatgtcgacccaagagtagccaccaataattggagagcggaagacgatatggcgcgtgcccggcacgcaccgttagcggcatcctagagtaagaatagaggggcggacaagtgtagaaacaagcggggcgagatggaggaagaaggtgaagttgaagcggcagggggtgatggtgtgaaagaggggcagcgttaggtgcggatgcgaggattagtgttagggttgtgaacagagttatgcggttatggctagggttatgactaggggtatggctagggttagtactttggctacggttagggttagtactttggctagggctaggtttagtgttagggatagttttatggttagtgttatcgttggtgttagagttagggttgatgttttggttagggttaatgttttggttagggctagacctagggttagggttagggctagacctagggttagggttagggttagggctagacctagggttagggttagggttagggctagccctagggttagggttagggttattaccccccctttttttagcccccccgggggatttgacgtaatttttaaaacgcg

SEQ ID NO: 191 - protein, 145 aa, herpes simplex virus 6A
MRTRAGPSKQSRDNLGLRVDFSFFMPAYVGVLSRLCRRGRVCAGPSRARDRGCDGNCALLRFRNEGVRPIGARGRGRTYTKGGSSRSPASWAEQGRPPFTLSVSGTVLCLGRGLPAVRKAGFCRRVSVHGYVAFGTYGKGTYGEG

SEQ ID NO: 192 - protein, 192 aa, herpes simplex virus 6A
MSGVLSCVLRACACAGLCCWVCMGAICGGCQRWWRRRCARWGRVGPRVRSGDGARWVSRKCETERAPSAARSPACSPHFVLVSSSSSSSCSSACSSRPLSSPPSPRAASHAVCAAGGCDLPTHDADGDADEGTDVTLSERAGADEGAGGNAAGCPEDTRGFARSPGDLMGGMNGDLGDEGETGEGGDNGAGE

SEQ ID NO: 193 - protein, 143 aa, herpes simplex virus 6A
MARVMTRGMARVSTLATVRVSTLARARFSVRDSFMVSVIVGVRVRVDVLVRVNVLVRARPRVRVRARPRVRVRVRARPRVRVRVRASPRVRVRVITPPFFSPPGGFDVIFKTRGIPSPGETVLDKKVSRPWRGLTSRRGATMI

SEQ ID NO: 194 - protein, 189 aa, herpes simplex virus 6A
MFPDANRLIIVCRRHRICFAFVLVYSLFNIIFLYSLSCLSRAYEIFTRLRRRMATARLSAMKPPRSCALIFLCAFSMATAPTNATAHRRAGTVKSTPPPEDKHSYTAKYYDKDIYFNIYEGRNSTPRRRTLSEIISKFSTSEMLSLKRVKAFVPVDENPTTTLEDIADILNYAVCDDNSCGCTIETQAR

SEQ ID NO: 195 - protein, 93 aa, herpes simplex virus 6A
MFGDIIICVPLSADNKGVRNFKDRIMPKGLSQILSSSLGLHLSLLYGAFGSNYNSLAYMRRLKPLTAMTAIRFCPMTTKLELRQNYKVKETLW

SEQ ID NO: 196 - protein, 216 aa, herpes simplex virus 6A
HPRYINTPSLLKRVPSIHPAASSDAPVTLETLHYLSYTLHSTPPPPPLEDRPHPCTRIRINPARIPTSFQSRNYGAGSLRNHKIFSRSPCLASPWGTHVFIHSSELIVSIEILKIRNNGGQTMKTLTSFAIVRKDNDGQDWETCTRFAPVNIEDILRYKRVANDTCCRHRDVQHGRRTLESSNSWTQTQYFEPWQDIVDVYVPINDTHCPNDSYVV

SEQ ID NO: 197 - protein, 89 aa, herpes simplex virus 6A
MQFFLICSTIFVQTGTSKQRFRNAGLLMVNNIFTVQGRYTTQNMFERKEYVYKHLGQALCQGGHVFYNPKEVKSENIKMINIKPTVVRT

SEQ ID NO: 198 - protein, 99 aa, herpes simplex virus 6A
MLARKNGPRYLQMENGPRYLQMETFISDLFRHECYQDNYYVLDKKLQMFYPTTHSNELLFYPSEATLPSPWQEPPFSSPWPEPTFPSRWYWLLLNYTNY

SEQ ID NO: 199 - protein, 490 aa, herpes simplex virus 6A
MFSIINPSDDFWTKDKYIMLTIKGPMEWEAEIPGISTDFFCKFSNVSVPHFRDMHSPGAPDIKWITACTKMIDVILNYWNNKTAVPTPAKWYAQAENKAGRPSLILLIALDGIPSATIGKHTTEIRGVLIKDFFDGNAPKIDDWCTYAKTKKNGGGTQVFSLSYIPFALLQIIRPQFQWAWTNINELGDVCDEIHRKHIISHFNKKPNVKLMLFPKDGINGISLKSKFLGTIEWLSDLGIVTEDAWIRRDIRSYMQLLTLTHGDVLIHRALSIAKKRIRATRKAIDFIAHIDTDFQIYENPVYQLFCLQSFDPILAGTILYQWLSHRGGKKNTVSFIGPPGCGKSMLTGAILENIPLHGILHGSLNTKNLRAYGQVLVLWWKDISINFDNFNIIKSLLGGQKIIFPINENDHVQIGPCPIIATSCVDIRSMVHSNLHKINLSQRVYNFTFDKVIPRNFPVIQKDDINQFLFWARNRSINCFIDYTVPKIL

SEQ ID NO: 200 - protein, 197 aa, herpes simplex virus 6A
RSVGTAVWGSFLPRRTRTLKSANGATAVPVFLHKDKDQWVPRLGSFLPRRTRTLKSANGATAVSVFLGKLKVSGYRGLGSFLHRRTKTLKAANAATAVSVFLGKLKVSGYRGLGSFLHRRTRTLKAANAATAVPVFLHKDKDQWVPRLGSFLHRRTRTLKAANAATAVPVFLGKIKVSGYRGLGVFPAQANENSKSC

SEQ ID NO: 201 - protein, 147 aa, herpes simplex virus 6A
KSVGTAVWGSFLHRRTRTLKAANAATAVSVFLGKLKVSGYRGLGSFLHRRTKTLKAANAATAVSVFLGKLKVSGYRGLGSFLHRRTRTLKAANAATAVPVFLHKDKDQWVPRLGSFLHRRTRTLKAANAATAVSVFLGKLKVSGYRG

SEQ ID NO: 202 - protein, 94 aa, herpes simplex virus 6A
MMEESIKEILEESLMCDTSFDDLIIPGLESFGLIIPESSNNIESNNVEEGSDGELKTLAGKYMNYIICPKIENKKKHSFKHVTYNILRISSFTS

SEQ ID NO: 203 - protein, 839 aa, herpes simplex virus 6A
MKQEQSDMEDKLIKCAGLLTQQQSMFIGLGLEQLSQLININLLSSASTKYVESYSKMLHGKELDFFNWCEPRFIVFACDKFDGLVKKVASESRNLLLDLRANMNNDIIKAVKDIFSKATVTLDCQKLNQGATMLMMMAHNKEMSNPDISSKDFCEKINTLKQTLLEGKNEIVETNAKNMQILQTFAIKQMNQIFMDGCDKAFLKLNVNCKNLITAAKNLANTILQSIVICSNEFSWQHLKLLRRGFKVTMLNMITQACECLESDYDDTGLIKPLTPLQIMDGYINMNKNRQSSICDGNTDPSDSMILDLADFDDHGRYSEESSIESIHEDDDNKMYPCTPSPEVPGKSKYVGTFTENSRQSGDEQTNPNCVGTASVTDLGGPDNLNSISGLQSCKNMLLERLLDTQCDSVVEGTEQDGSYGNTLISEMMMFGYETDHSAPYESESDNNDEIDYIANSDSAARTNNIHMNSTDENTPFSNSICSPPEVTPSKKNVKPKSMTPGSKPKKRVAKRKHVSSKSPKNKKIKTDQLPKAADVIVISSESEDEEDGDNIIGNSILIKAIKSESDSESSSESNDCTSEHKQLHLSDYDEVTNNGHCPSYGFPTPVFTIPIRSMQGTGGIKSKFIPKKNWIWYMKKTHQVDNCPIHNSENVDAKDDSDGTEAKHCFMNHFVPIKTDDEDYDKNNVSYIYNKIQNSKIDSGDIIPTKKLIIDMVMDNFMDLNDIIKQGITKHCQDLCNKYNVVTPTTCEDDLNMTNSQTFATTATQVFDPPVTGNNSSILNIINDTTSQNDENRCTEGTSNSNEKCTNISDCNSDGTEAFKLDGYPSDYDPFVENAQIY

SEQ ID NO: 204 - protein, 715 aa, herpes simplex virus 6A
QGSSRASSRASSRDSSRASSRASSRDSSRASSRASSRASSKASSRASSRASSRASSRDSSRASSKASSRASSRDSSRASSRDSSRDSSRASSRASSRDSSRASSKASRKASSRASSRASSRASSKASGKASSEASSRASSRNSSRASSRASSRASSRDSSRASSRASSRDSSRASSKASRKASSRASSRASSRELRQIYCDSNKRQTPPHDTSINTKFEISEIKFRCGEDLNFYKNTAARLQCFNHNDQFYNPRFRPHIRTNRKKSESTNDTDSESSMSRCKSHCRNSPDSLTVVRRKKHKSGSSSISSSIEENCRSNSHIVTGKEKFTPFYYQSSRTRSSSSSSSSSASLSCSKSTLKTCRKTQYKDNKQIKSKSDSKHKTTNMSSDYESNRHADVFKNSPEAGEKFPLHNSSPFNTHEQSNHSENAIDEEQKKAPNITTSHLQGKQNVRLHNTKKCKKKRPRDDDSDSSIKNFCKKRISGAQKTESEVSEPDDLCYRDYVRLKERKVSEKFKIHRGRVATKDFQKLFRNTMRAFEYKQIPKKPCNEKNLKEAVYDICCNGLSNNAAIIMYFTRSKKVAQIIKIMQKELMIRPNITVSEAFKMNHAPPKYYDKDEIKRFIQLQKQGPQELWDKFENNTTHDLFTRHSDVKTMIIYAATPIDFVGAVKTCNKYAKDNPKEIVLRVCSIIDGDNPISIYNPISKEFKSKFSTLSKC

SEQ ID NO: 205 - protein, 290 aa, herpes simplex virus 6A
MSSLMLRLLPLLYIISAHFVLHPETSPSLIYEIGSIVTFHCRLETTTNIRSVSWYNKNRLISNHEVQNMDNLSFTDDGYVLIHELNKINNLAVDSKLYFHIKHNRTTSLLKIKAKSAYDATCLTCTFTVDNEKTSATSCLKLFMKPIVVLYFRYLDNFLDVTCTVTSYPKPNVVIKFLGEVYKRDIPIVRQNENGSSTVSVNFTFKRRTKLEFVGKTVSCLASSWFTNQKASALVTSGEHTVQNHDEYSKEGVKSSNSDETVFTWTVPLILILISVIVLLISVCIVAFKS

SEQ ID NO: 206 - protein, 342 aa, herpes simplex virus 6A
MKDRGNKNTSKTRQTVKSRRTRKTTKQFVERKKNLSAKTTIRNNRLQNNLSPQTTPTEKPVDYATARVFPQHTPYDIKFNKEKYRNNEIYAYSKLRKISNAVFRQEKEINRLTVFTDKPLADLSFKMPVNTSTTEKKEIVRSTECQRQDRNTVNAFKIFQSYETSPPYSPCSPKNFMSEIYRLFRCYNASIVQIQVYSRNKILINAMQEKLMSIGNMVINVGEQIISESVHHEPVVAIAINQFFRGTVPQTDALRKNAVTPIPVNASKKKLVGICSLMINAPTEKDLLCAAHVCINFAICYPNEITLNIAKLTQPMLLQEHITIYNSFNKYIYWDDYGKLLN

SEQ ID NO: 207 - protein, 250 aa, herpes simplex virus 6A
MELLLFVMSLILLTFSKAIPLFNHNSFYFEKLDDCIAAVINCTKSEVPLLLEPIYQPPAYNEDVMSILLQPPTKKKPFSRIMVTDEFLSDFLLLQDNPEQLRTLFALIRDPESRDNWLNFFNGFQTCSPSVGITTCIRDNCRKYSPEKITYVNNFFVDNIAGLEFNISENTDSFYSNIGFLLYLENPAKGVTKIIRFPFNSLTLFDTILNCLKYFHLKTGVELDLLKHMETYNSKLPFRSSRPTILIRNT

SEQ ID NO: 208 - protein, 255 aa, herpes simplex virus 6A
MALLQWMLDHVQDEEKNCENLSIDDQHSLFGINRDWLSFLQLSKLEITHLKHVYKLVDNDRAHLMVHPSSDNVHAWSFLCKPDNVKVVILGQDPYPDGRGCGLAFGTVKECSIPESLKNIFKELERSVPNFSPPDNGCLNSWCSEGVLLLNSIFTVVHGLPMSHEAFGWQTLSYKIISKLSVEMDSLVFLLWGNHARKLSYLIDARKHLVLESAHPSPKVKSARMPFIGCNHFVRANLFLTEHGKDPINWNILNE

SEQ ID NO: 209 - protein, 109 aa, herpes simplex virus 6A
MNMLAYFLYCRQLLLAVVLIEFPPRLCGNTLRFYSYHLPLSTCHISDSFYLTSRTTSNLLFCHLLYCHQKSHQKSHQKKTTGYLKLFSNTIENIKNMFNSSPYTLSTTA

SEQ ID NO: 210 - protein, 249 aa, herpes simplex virus 6A
MKSLKKLKELETSDVFNILHVRTILKVIKIDKCISLARHPLVNITVGDDGIWFHLEDGTMINGLEYKTICEKELGFQGFIGIIILDSEDTLQELRLNPFQFKRRLIHMKVDTPEEFMLCGLVFALENLPLKQSTLHKLIAKLVLFPALSPITKILFNTCDTLVCTLRHIFFNEHASEILHKVPLMIRLYNEMKNTHIEVLELYFNTKRSHNFINLSLESRQLQDSSLQVIQLATQFAQTFYSKNGDTSS

SEQ ID NO: 211 - protein, 344 aa, herpes simplex virus 6A
MASSRVDTINLRIWLVSIICAALSFINVTVYLIAINFPNLGFPCAYFEINDLKAVNLSANNQIYQMTHQLYINPVQIICYVLIMAMLFLLIIIYYIVCCAKVFSSNKTSNVNQTTRDITWMGDTSSCFQFILIMDTFQLFVTALSFRLVALGAFAYCIFFVCFTTFNVTLITQFQSADKSFFAFQKIHPNLKGTVQFKTVVINLTELMLGYSTMFLGITTCLGVGNSIYIRSITVAYSSINTFLVMACIYSIVIEAVLVRYVKPLFGYYVGMFCGAVGLSFPILQYETFFESEWSTGLIINLAVIAIISIGFIICRLVRYLVKKKRRYKQLVNTESSSLMDENE

SEQ ID NO: 212 - protein, 305 aa, herpes simplex virus 6A
MLRTCDITHIKNNYEAIIWKGERDCSTISTKYPNSAIFYKKRFIMLTPELGFAHSYNQQVKPLYTFCEKQRHLKNRKPLTILPSLSHKLQEMKFLPASDKSFESQYTEFLESFKILYREPLFLQIDGFIKDFRKWIKGEFNDFGDTRKIQLEPFQKNILIHVIFFIAVTKLPALANRVINYLTHVFDIEFVNESTLNTLKQKTNVFLVPRRHGKTWFIVPIISFLLKNIEGISIGYVAHQKHVSHFVMKEVEFKCRRMFPEKTITCLDNVITIDHQNIKSTALFASCYNTHVSTINLTLFSEIKN

SEQ ID NO: 213 - protein, 322 aa, herpes simplex virus 6A
MKLNNSPFEMLSVVSYVCEDHAHMLNERGNATACSCYRLHKPKFISINAEVKKTANLFLEGAFIHEIMGGATCNVINDVLITEQGQTEFEFFRYSTINKNLIPFLGKDLYVYLDPAYTGNRRASGTGIAAIGTYLDQYIVYGMEHYFLESLMTSSDTAIAECAAHMILSILDLHPFFTEVKIIIEGNSNQASAVKIACIIKENITANKSIQVTFFHTPDQNQIAQPFYLLGKEKKLAVEFFISNFNSGNIKASQELISFTIKITYDPVEYALEQIRNIHQISVNNYITYSAKKQACSDDLIIAIIMAIYVCSGNSSASFREI

SEQ ID NO: 214 - protein, 1345 aa, herpes simplex virus 6A
MENWQATEILPKIEAPLNIFNDIKTYTAEQLFDNLRIYFGDDPSRYNISFEALLGIYCNKIEWINFFTTPIAVAANVIRFNDVSRMTLGKVLFFIQLPRVATGNDVTASKETTIMVAKHSEKHPINISFDLSAACLEHLENTFKNTVIDQILNINALHTVLRSLKNSADSLERGLIHAFMQTLLRKSPPQFIVLTMNENKVHNKQALSRVQRSNMFQSLKNRLLTSLFFLNRNNNISYIYRILNDMMESVTESILNDTNNYTSKENVPLDGVLLGPIGSIQKLTSILSQYISTQVVSAPISYGHFIMGKENAVTAIAYRAIMADFTQFTVNAGTEQQDTNNKSEIFDKSRAYADLKLNTLKLGDKLVAFDHLHKVYKNTDVNDPLEQSLQLTFFFPLGIYIPSETGFSTMETRVKLNDTMENNLPTSVFFHNKDQVVQRIDFADILPSVCHPIVHDSTIVERLMKSEPLPTGHRFSQLCQLKITRENPARILQTLYNLYESRQEVPKNTNVLKNELNIEDFYKPDNPTLPTERHPFFDLTYIQKNRATEVLCTPRIMIGNIPLPLAPVSFHEARTNQILEHAKTNCQKYDFTLKIVTESLTSGSYPELAYVIETLVHGNKHAFMILKQVISQCISYWFNMKHILLFCNSFEMIMLISNHMGDELIPGAAFAHYRNLVSLIRLVKRTISISNLNEQLCGEPLVNFANALFDGRLFCPFVHTMPRNDTNAKITADDTPLTQNTVRVRNYEISDVQRMNLIDSSVVFTDNDRPSNETTILSKIFYFCVLPALSNNKACGAGVNVKELVLDLFYTEPFISPDDYFQENPITSDVLMSLIREGMGPGYTVANTSCIAKQLFKSLIYINENTKILEVEVSLDPAQRHGNSVHFQSLQHILYNGLCLISPITTLRRYYQPIPFHRFFSDPGICGTMNADIQVFLNTFPHCQRNDGGFPLPPPLALEFYNWQRTPFSVYSAFCPNSLLSIMTLAAMHSKLSPVAIAIQSKNKIHPGFAATLVRTDNFDVECLLYSSRAATSIILDDPTVTAEAKDIATTYNFTQHLSFVDMGLGFSSTTATANLKRIKSDMGSKIQNLFSAFPIHAFTNADINTWIRHHVGIEKPNPSESEALNIITFGGINKNPPSILLHGQQAICEVILTPVTTNINFFKSPHNPRGRESCMMGTDPHNEEAARKALYDHTQTDSDTFAATTNPWASLPGSLGDILYNTAHREQLCYNPKTYSPNAQFFTESDILKTNKMMYKVISEYCMKSNSCLNSDSEIQYSCSEGTDSFVSRPCQFLQNALPLHCSSNQALLESRSKTGNTQISETHYCNYAIGETIPFQLIIESSI

SEQ ID NO: 215 - protein, 296 aa, herpes simplex virus 6A
METVYCTFDHKLSLSDISTLCKLMNIVIPIPAHHHLIGSGNLGLYPIVSSNKDYVHVRNVLRTMVVTILQKVEGNQLVLRKPVTGHQYAIKNTGPFPWEKGDTLTLIPPLSTHSEEKLLKLGDWELTVPLVVPTAIAAEINIRLLCIGLIAVHREYNEMQTIIDELCSIQYRDVLIKLPDIVNDKQSMYSMKTACISLSMITAMAPDIVRTYIDRLTLEDHSMLLIKCQELLSKRTTLNTQRCGQLHATEIKDELKKVKSVLTMIDQINSLTNEKTYFVVCDVSADNRMATCIYKN

SEQ ID NO: 216 - protein, 432 aa, herpes simplex virus 6A
MFSPQLNHVLQLVFDCNHIVSNSYQEIILKCRISSTKPGILFITDGTESETEDVLFDVQFLEKTTTIKIKILPISRTVPVRIHLFSIPIYLPSHALEIDDINALCQKENIDPTVYEQYGLTNMPISTTNVINQFKVVQNDSVEMSLILFNLNWTESPYQSQKLDRYGRKLLIVFSVFSIDTRECPYWENLFKSIIPLCRVNMISEPGISIYKIEFNDPFLTVFLRNVVLPENKRRFPITKECYLRLTFSPPDRSTVTLNMNMPYFKICADGKNLEVFFPNDMSLVSNTNKEITLRGEFTNKKIVGIFIPVQTHVFKLYPFLWFAQEPLKLRISCERTVSVTEHDMLGRVFFVTKKLFRKPFRSLSNSDMKSLLTHTENTDKPFDVHFMGNCFPAYLLPELTLHPLEYEDKPARGNPQTLPSVEKHSIIKIRI

SEQ ID NO: 217 - protein, 458 aa, herpes simplex virus 6A
MQPATLQWSSYVLQLRVTTTAILKPGELRLFKCGLGITPPSSAVVCICRDESSFTSSPFTYIDPKDYGNIPFAVQNISDLDLDLSRLPIVLNIFALPHANVNISNLPVQRIEAHDRHIIPHGQCDAKFVIYGPLTRIKIQVADIRWIEQTPEEPTRYSFKAEIWVNLQNTPLDQIFKTGNIEFISHKNVYISRILLCGNLLILKANYENDYLLDDNFYPEQLAIQISLTPQTADITLSQNQETLLKCNTHSITVCATKNIIPNTVTPVHCSFNTIFNSNSNFTGLFIPKLLLGISTTTGIWDETRPLYITMKAFKKNRRINYSQPIGVVYFFPKQILPPGNNVEFNWTEASKIYVNTESPNGPVRNTVTFTNQAVLRTPSLSTVANLTPDINMGIFLSSLRVAFDTAHMVPLHFSLKPGESTRMEFMPPGTPQNLTILEGDVGIHFIPCHNHSHRSSP

SEQ ID NO: 218 - protein, 258 aa, herpes simplex virus 6A
MTQIGQYIKLNDAVPNLILHITTKLLRNENLTSFKQEELLLIQHVCTSMLSHGIKILLLRESLYNSGIGDIVILNRKISNNYWFRIFSILKQHSDAELLRHMFNESHSAYISKKLHYSGNVSHMINFLFMDEFGVNLKIPEELICEGNIVFSVGAIYNHRLLKICRFFNRFWGDQEREPTVRLICKHLWFAYLIMFGKFEISTLAYSQQRAEHKAGLFSFLQNDFKVFCGMSENPQLLDSSAIFDLTGISAEDLFSYE

SEQ ID NO: 219 - protein, 694 aa, herpes simplex virus 6A
MLLRLWVFVLLTPCYGWRPLNISNSSHCRNGNFENPIVRPGFITFNFYTKNDTRIYQVPKCLLGSDITYHLFDAINTTESLTNYEKRVTRFYEPPMNDILRLSPVPSVKQFNLDRSIQPQVVYSLNMYPSQGIYYVRVVEVRQMQYDNVSCKLPNSLKELIFPVQVRCAKITRYVGEDIYTHFFTPDFMILYIQNPAGDLTMMYGNTTSINFKAPYKKSSFIFKQTLTDDLLLIVEKDVIDVQYRFISDATFVDETLNDVDEVEALLLKFNNLGIQTLLRGDCKKPNYAGIPQMMFLYGIVHFSYSTKNTGPMPVLRVLKTHENLLSIDSFVNRCVNVSEGTLQYPKMKEFLKYEPSDYSYITKNKSISVSTLLTYLATAYESNVTISKYKWTDIANTLQNIYEKHMFFTNLTFSDRETLFMLAEIANIIPTDERMQRHMQLLIGNLCNPVEIVSWARMLTADRAPNLENIYSPCASPVRRDVTNSFLKTVLTYASLDRYRSDMMEMLSVYRPPNMERVAAIQCLSPSEPAASLTLPNVTFVISPSYVIKGVSLTITTTIVATSIIITAIPLNSTCVSTNYKYAGQDLLVLRNISSQTCEFCQSVVMEYDDIDGPLQYIYIKNIDELKTLTDPNNNLLVPNTRTHYLLLAKNGSVFEMSEVGIDIDQVSIILVIIYILIAIIALFGLYRLIRLC

SEQ ID NO: 220 - protein, 651 aa, herpes simplex virus 6A
MHLEVIVQSYKKSKYYFSHTFYLYKFIVVNSPDMLHISRLGLFLGLFAIVMHSVNLIKYTSDPLEAFKTVNRHNWSDEQREHFYDLRNLYTSFCQTNLSLDCFTQILTNVFSWDIRDSQCKSAVSLSPLQNLPRTEIKIVLSSTTANKSIIASSFSLFYLLFATLSTYTADPPCVELLPFKILGAQLFDIKLTEESLRMAMSKFSNSNLTRSLTSFTSKNFFNYTSFVYFLLYNTTSCVPSNDQYFKQSPKPINVTTSFGRAIVNFDSILTTTPSSTSASLTSPHIPSTNIPTPAPPPVTKNSTKLHTDTIKVTPNTPTITTQTTESIKKIVKRSDFPRPMYTPTDIPTLTIRLNATIKTEQNTENPKSPPKPTNFENTTIRIPKTLESATATTNATQKIESTTFTTIGIKEINGNTYSSPKNSIYLKSKSQQSTTKFTDAEHTTPILKFTTWQNTVRTYMSHNTEVQNMTDKFQRTTLKSSNELPTIQTLSVTPKQKLPSNVTAKTEVHITNNALPSSNSSYSITEVTKEVKHTRMSASTHEQINHTEIAQITPILNAHTSEKSTTPQRSFTAETFLTTSSKPNIITWSNLLTTTPKEPLTNTSLRWTDHITTQLTTSNRTQSAKLTKANISSQTTNIYPQTITGRSTEV

SEQ ID NO: 221 - protein, 376 aa, herpes simplex virus 6A
MYSAISEKISETITLQRQTSSRYIEFFVFRNVDINELWTTDISEDKTHDVWPAVNEKSFKKFLENELTSYQRPIPLLGIPQNGTVSKTCKKEKQRETDCVNYERKRGNPVTFYPRHRAKRNANTDTCISEEPSILVSHHRNSKMDVFMDTNKITLVNRELIWVPHDQVRIVKLDISLYIPDGFFGVITGHSNDVFCECVTEIITDETDISVFLMNLSEHSLMLLPGDVEFSINFLPCYIPEPWEMINLSPPEFAIFHLKASREFIAKPNSYTIQYFDAMYVCADELKALMIPSKEIAKLGLLIETYIWNKDTIPSIKIFNSTRKTIYIPTGICIARIIFTCGHFCLSLMPERAINRLQVLDANSSFLFHYAASNNA

SEQ ID NO: 222 - protein, 860 aa, herpes simplex virus 6A
MTIVVFATEYDAANVIFSILCRSPSEHLIFPIIVKYKPSNNVSFCLQTQKCKNSKRIDTVFVCHAEKLNLSHYIQTASPIKAEDVANSLNDKETESLYVDMILSQTGKEREDVEFKYMAYFHKSLIIKYLTGKFLLPTSPFWFLSTYGQTEGMLLLTMFYYLFEEQKSTITTTKNYVQCFTENTGNMVFTYSSMSEFINITLKSKFRKLFADFSTYARQKNLRDKEEFKHLDTQINLFRKSSHLTNTFRVHYIYIAYNTALETTKFVNYCNLTSYDSNLPIGQQCQRNLHILGNSLHENLLCIMKQYFNADCYFKTYIDIKRLKNPNLNVTEYEYALVSKKKTIQALTSEQITRAIAKCNKNGEGLFSPVKPGLQGLLEISASDRYVQIQDKRIYRRQHLHKDYHRPFPVFRVQLLHKNIFCFGNSEDWYENMGFNRILQYLPDEYISDEALTRAIWLQDTHFLCDDVEKQFYTTRHEIFNERIPVTNYIGDLDLPLQDTATITEETFFSMCRLIRLTLINAWKKIFPSIDTDTHPIFFFKTQCDTTNDTLDYTEDPTEIKQFCVCRKKIGLRISIPLPNGTAIAGGEPLKQLSKILNHVMCLDQELSQILNSITFPGECFDIGIYHTGHCIRIGYMYKTDMDKGKMLHGRLTPIFIVPEGYRNSCKTFIQMQMDLNNLLHHGTKKAPIEELIYNITDKGCPKENLSFMDLKSRQLWNKVNIATETLITKYLNTHGFNNNATSADDSLLSFIRLIGWPIIKTQLITHYETRIAQQFSQVTFIKIDSKNLQIKKTQFGRVSDFSCLNRQHRGNRDNVLVYIQLKADGNRLILILWSTCFATKCQSNSKQVHCSIALEQLKN

SEQ ID NO: 223 - protein, 514 aa, herpes simplex virus 6A
MYPRGVKRSHHDYHRQTAFRTIKRSTHRQTSKFISHFAKNFRGKLAPLKHCESRLDALSLTELEQLKTIIEEKQQEKRAQNNAITFLPNLPTVPFADTNFSLKSLGLRPYNGDARDPKQRIRDRFPQTHERICLLTNDILETDLLLRYRQCLDSLTREENQQLMGDRIFSLTNSPCLAFTVATVEEACSYFKFHDLHNLPVNPQDLFMYTITVMKFEFFNKLNMAKLTCVFNDNGHGDIEYRKLRQLCGKPVLDREMPNSELEVQQQTPDSFRHPIQQAMSIVVTFARILRQIKEQIIQTKKPQFIRDFDTGRVAERYECGLMSRLIGKQFSNHKCDDVSCQNRIERIMAPWKPSLFFCTYFAKDAPKFKLFPNFPEEYRNLSFTCPKVDTEPSCSYSTNHDLPQTSHRSHKNHGTPKVKSKVCVEKPDTSILTTTKTTTEILIEESMETDNKIPNPRELNFNQAKQEEIVIININENVNSKHESESSVEMDLDLDYEADTCETNLNACSSDSE

SEQ ID NO: 224 - protein, 1132 aa, herpes simplex virus 6A
MADENETVVSAPVSTAAWIYVFPKDKELLDVLSVLSLMERNSPIVISPLLMNLTVENDFSTTVKTPITNFGGTILTKITSFMPVCFFFHGTEQLVGMAEDHGDLIRLCEQTRQKFHLQSFEVPTARKVIDIKALCSAVGKDADSVICHVACGNGFKELLFAGLLIPCVEEQIQVQVGEYSCVKIPLYSATLFETEETISLSSCTEFIQERGFFLPALSETLFYYVFTSWGTTLRFSNTKELIDAGLKQFTQDGEQTVKLAPHKTYLGISGQKISAVEKDFLMLVDSVVTELSFSHVAEYLDSVYDPSQIMNFNDWPIIRNSETHAERMAQLTNLKLHLSSHLAVLIFAPNSILYCSKLAFIPNVKQAFNSVMTQELLLRSLSFCNALSSLSDDVYNDNRKIIKCDSTSGKDDKFSANHLAYACATSPQLLSFVVWNLNRMSVYNAGNAHTEIYNHLVNCSANLCEFCDGKCCQSCIGTAMVRVGTRLPAIPKNVKKEPLVMSMFSRYYAEVDILGSFGRKPVSELKEIGKDQQNTLSLDRGKFVSQIFDYCKKNSLIDPVTGEDTFNVRSKKDFVSIIHGLTQCIEECVSRCIVEMRRTQTPREQIENCLQSFNVDTTPYATAFSPFLTFSYYKVILTVLQNLALIVASGHVVDRPCTGNSISKWLVQQYQSLYGTFHSSYLKKGFLNTRTVKVASNVDMEQILDCDLYKSGKYVKTTIQAKLCRLSMQCLRDFRIKNRPFNKSSKTAHNNPYFKKNVKHKKNPLSGCISFLLFKYHDKLFPNVKISCLELWQRFLLNNVPKTLDIGNPEEVKTFIKFAFSITNTYDEIDIIDIQPECLSTFIDCYFHNKFLSALGFHDYLTSLHGLTSKLVTQNPVLFPVVLDKQPKFSSIQEYLVYVKKLVLDGVPNPVIASLSKEPNFGTIFTSRSLVTFGLTLEKFVSLANREYFQFGQLGWIGGSGVDRNLNPTSSALQDFRFMRQKTIIATKFSEVIVKKVRREAIMFDTEVVKGKVLSIVENLTNDIDPELLIIAEVMRDREDKPTMDDMLFFVDGREALAASIMLKLNHLVDMNVKDFSITNLQSVFETVSSNDAPVYDFSEILAEEDDQGNGVLKCDETETETDEPMTKKNRL

SEQ ID NO: 225 - protein, 726 aa, herpes simplex virus 6A
MNSLQSLCVLCARLNECALDLECLKFCDPVIVLSDMANFKKNGIVILHLYQTFFEGIKEQNLLCASALTVYMQVLLKAMYEQVLLLDAALESFMVDQDRKKYFEKVLCLRRCAETLSINISLNNGVEFIVQLSTLNDIEQLISKINSVYALLLPQEGLQICGKIIDLLTIMCGACMVAKPESYLETKTCMKCYEELTLTPNQGKSLRRRLHGKFCNHLTEQKAFFNIEKNIETIEKDLGEAILNYGTVQSVATEIKKIFKQQRSAESLHVSDAEKTLKKYNIFSKVPDVIYSLSEFTYWSKISETIVRNVAITLQQLNSCHTLYKQLQNDVSLYLYGEVSEDFLALSENLLTHDERLYVGSIYVSPSRLIDLVTGLSIKNLEESPIFKRLAEEDEVQHKIKSLLHDIRDPQTTETPGRLNTINCMLQTHNLQQEVLARKKAYFQKVSESGYNRVMACIREQESLINKVVSVNVYGNFIFEALSKIMNGFVLRKMYLDGSFRVDSCTYDEHLYIKNNLMPKKLPLELLPDLSEIMYTLLTGPLSDFHKSAYPLPANISMAYGCDHAEMLPHMKEDLARCIEGTIHPSVWMVCEYNEFFNFSGVTDVNDMQKKMWNFIRELTLSVALYNDVFGKRLKIVRIDEEGDLSGNVVLTFNHESPLLFHTGGGMTKFKDVYSLLYCDLQAQLSRETVDVPEGVSYSVRTPNLLDLVRENEQDGSIIPGCLFDE

SEQ ID NO: 226 - protein, 1012 aa, herpes simplex virus 6A
MDSVSFFNPYLEANRLKKKSRSSYIRILPRGIMHDGAAGLIKDVCDSEPRMFYRDRQYLLSKEMTWPSLDIARSKDYDHMRMKFHIYDAVETLMFTDSIENLPFQYRHFVIPSGTVIRMFGRTEDGEKICVNVFGQEQYFYCECVDGRSLKATINNLMLTGEVKMSCSFVIEPADKLSLYGYNANTVVNLFKVSFGNFYVSQRIGKILQNEGFVVYEIDVDVLTRFFVDNGFLSFGWYNVKKYIPQDMGKGSNLEVEINCHVSDLVSLEDVNWPLYGCWSFDIECLGQNGNFPDAENLGDIVIQISVISFDTEGDRDERHLFTLGTCEKIDGVHIYEFASEFELLLGFFIFLRIESPEFITGYNINNFDLKYLCIRMDKIYHYDIGCFSKLKNGKIGISVPHEQYRKGFLQAQTKVFTSGVLYLDMYPVYSSKITAQNYKLDTIAKICLQQEKEQLSYKEIPKKFISGPSGRAVVGKYCLQDSVLVVRLFKQINYHFEVAEVARLAHVTARCVVFEGQQKKIFPCILTEAKRRNMILPSMVSSHNRQGIGYKGATVLEPKTGYYAVPTVVFDFQSLYPSIMMAHNLCYSTLVLDERQIAGLSESDILTVKLGDETHRFVKPCIRESVLGSLLKDWLAKRREVKAEMQNCSDPMMKLLLDKKQLALKTTCNSVYGVTGAAHGLLPCVAIAASVTCLGREMLCSTVDYVNSKMQSEQFFCEEFGLTSSDFTGDLEVEVIYGDTDSIFMSVRNMVNQSLRRIAPMIAKHITDRLFKSPIKLEFEKILCPLILICKKRYIGRQDDSLLIFKGVDLVRKTSCDFVKGVVKDIVDLLFFDEEVQTAAVEFSHMTQTQLREQGVPVGIHKILRRLCEAREELFQNRADVRHLMLSSVLSKEMAAYKQPNLAHLSVIRRLAQRKEEIPNVGDRIMYVLIAPSIGNKQTHNYELAEDPNYVIEHKIPIHAEKYFDQIIKAVTNAISPIFPKTDIKKEKLLLYLLPMKVYLDETFSAIAEVM

SEQ ID NO: 227 - protein, 106 aa, herpes simplex virus 6A
MMDSSPEKTNLELLYERVCEQGREFEVVFYPMLPRLYEMMLPSLEARLNFLSVGYRHVAFARYVHGDVDCVHREVMAQKMVLLTSILSKLLNVNGILEHQEYLNTE

SEQ ID NO: 228 - protein, 470 aa, herpes simplex virus 6A
MFYLKKLLRQLLAPLCKHGSYTHLQLFVMGEACVPGKCVLTMFLTNKKFLNKEVTEKFYNEFFAIWLRCRPETRLITKRLFNKMVMTKGLFVLLAYLYFVYRQCKVLELLSLYKLKTIKWVDVETRFRVYPPYKLNKLLEMPSFSEINELHMFLFEQQLLLPIPTHVNLPCMRLFCLRDYEQTETVMLRYRQREHVLSFPSMLRKYALKSPAGNFMFTMAKALVENFCFSADRYLIPVEHNNLVPMVPSKPERGDFPKILTFALATSLKDGLATSVISLPVMCYCKTKCSRFILEESYICVICAKCGHCLNSGKEKLCSPQGFSLSSMFYFRDKQEKNLIYSMHTDVMYCSLCGSQQLVFERIYEMSEHCVLGMKVKTVSWKAVIGTNSACTILNDNVKFDVIVPCSCRSCYSTVHLYNVTVKKLLRLVSHGSDFQCQRCQHSFRETCLDLEDCVNICQGCQISQNVRCI

SEQ ID NO: 229 - protein, 88 aa, herpes simplex virus 6A
MTTIRSDDLSNQITQISGSSKKEEEKKKQQMLTGVLGLQPNMASHPVLGVFLPKYAKQNGGNVDKTAFRLDLIRMLALHRLNTKTGSD

SEQ ID NO: 230 - protein, 299 aa, herpes simplex virus 6A
MNSKSSARAAIVDTVEAVKKRKYISIDEGTLNNVVEKERKFLKQFLSGRQNLRIAARVFTPCELLAPELENLGMLMYRFETDVDNPKILFVGLFFLCSNAFNVSTCVRTALTAMYTNSMVDNVLSMINTCRYLEDKVSLFGVTSLVSCGSSCLLSCVMQGNVYDVNKENIYGLTVLKEIILEPDWEPRQHSTQYVYVVHVYKEVLAKLQYGIYVVLTSFQNEDLIVDILRQYFEKERFLFLNYLINSNTTLSYFGSVQRIGRCATEDIKSGFLQYRGITLSVIKLENIFVDLSEKKVFV

SEQ ID NO: 231 - protein, 804 aa, herpes simplex virus 6A
MKRKERRINKDYGYNRKCVCHYEASQKRFCYSQYSCASVLYERVRDIAKIIDRLDSGLDAWCLRDAIISVLRATHCVPRVDRMLGRWYLKTSVFYDFCPDDLILSCPNVIMPNVLNFVKKYRDFIRSVLYKVSVSWKNQYMPGVLAASRFLEEISNSLNGVEESIPCIYLRMCATLTEIVLRIGYLREIYQENPYVMFEELAFSLFTQKWVLPFSCMTNLGLVEKANSTVFDVAIYNTCLYSLVDFTIVNGEHLFPALLNGSNISMNLTRYQQEAKNIFEILLSQIRVVERDTDKTVQLTVYVEVWHVSALMWLDLYEALPQTSRVTFCLIIPGIFMDRYELKRAQWSLFHKNIAFELGKCDEITFSTKYLEFERTTDHAKITMSSFIEKICLCLKGGRMGLIFRKNVYQYSMIPHVPLYCGGDFLDVLPVRDGINTCMRMLLNVVHFLGDEVSDELTEEIDFVRLQCKFFMFNELRRVVRKMVLVANAVIDYAVENKDFLCEGIEDGRSLGICVTGLHSVFMTVGLSYAHPDARRLYRMICEHIYYTCVRTSVDCCMKGAEPCNLFDRSKYALGMLYFDHFDNVECTLPEELWTTLRKDVLMHGVRNIHFTAGTAMQKEFDIINSSESFWPMEDNKILRRSNIKVVIGKDGLNDVTSVYSSELKSLYIPVYNNLLLNRFNKHQQYLKTVGYRVLNVDTNLFTDKELDDLAVFKDGFSYHLNDLIEMYKSGLPFLDQGQANVFYFNDTVSLRLLLPLLYKAGFKVAMYKVLCNSEMYKHLDLSNPLPLIGKCSDGVVMHVKNIL

SEQ ID NO: 232 - protein, 295 aa, herpes simplex virus 6A
MRRLTDSFILGLAKGAVIPGLYTFRMTEGRSPLGQIGVLITVAISFLLTFKRFDPRFYKPIGDFKIVFLSLMAPKLPSLLSAVVMICLIFSEMRLRMILSRCVMIMPSYSPAVFTGIMVSLFFKSQMFDDYSVLITAASLLPITVRYGWMIRSSGFLLGLQKYRPILKSTSFREVDLKCLVKFTVEFLLLFTMLWIGKMFLSMPKSNHLFFLTVVNNVFFKLNVFKAAACAVVAILSGLMMNVCLYRIIFEAFVGLGFSSIMLTLSSDLKDRSFYAGDLLNGFFCLVVCCMYFGV

SEQ ID NO: 233 - protein, 316 aa, herpes simplex virus 6A
MGLSSSKDIDLLVNFIENRQGATLALPWPEDYRLTLHSVENIPEISREDVQNWAKTYMCCGGELVVVGVIHKAKTRTCRGPIVLQGARGHIYVYNGFFDRSLYHVASSFHDLFSNGLRFFYPIYETCDYALDSTVALDMIAHSKSFSELLHYRNERKNAFFTLKTYPYKTFVRFCNLSMTEFSSRHLIQWRRKLQTSLLDVVFIVQHNFFGDWRELVVVFDGHGMLFCVDREESLLFIARNMSDFLKIGCLRYNENRRLHTQWFTQDTDYIKQVDEMFSRDVLCPLREHCQRSRRERGLLKICTSLVRGVNCIERG

SEQ ID NO: 234 - protein, 57 aa, herpes simplex virus 6A
MLLISKTLFPIPRGADEFWEGTYILVVAFVLAFLVYSDFLSNLSPFGEILSSPCIST

SEQ ID NO: 235 - protein, 87 aa, herpes simplex virus 6A
MDPPRTPPPSYSEVLMMDVMCGQVSPHVINDTSFVECIPPPQSRPAWNLWNNRRKTFSFLVLTGLAIAMILFIVFVLYVFHVNRQRR

SEQ ID NO: 236 - protein, 236 aa, herpes simplex virus 6A
MLFLSFLLVCLCEEVRMLNLMTTEVSATEFASIASKNMETDVSTSSDYLTGKSETTFSANSETWGKNVTEISIDSETYLNQSFMVTSTLAVETTDRSIGNNVNVTSSFPTVKGDETQNIETSFTVISASTFSDVSEKTPQGLSTKSTPKKTVQALWETDTVQVLEFTDTHEGDEEYFKDFLSSLVIWIGGISFIGAFVILIVILCNWYKKDKQRSLFWDEEKKPDVQMRRDVKTCR

SEQ ID NO: 237 - protein, 202 aa, herpes simplex virus 6A
MVPQGCSLVWVSALYVSVIASLHIINNENSVFIATHSETELRHWLIFVKMAQRNGTAWWRMASVPINAYFERDIAFLFNPRCVIETAMGSKILCRYNKNIGVVFVDNDTKCNVSFPSGVQLQLLNQSVMESIRTKTYVVDYARKTTERGDCFISVAFCRKERRRFLSRCERFVYYCISVYLFAVVVLCSCWFALDPLFNMWA

SEQ ID NO: 238 - protein, 433 aa, herpes simplex virus 6A
MMICLVFLCVLTLARGEIYPPICPAPGVGNDEAVRAGELLLEISAYRNQRSGRVELWGSAAVNNQVFYGGMENSQIDYDFGKFLVFRCFQVFNNVHKLLFNTVSSATMHLARKRVQKCGHGKMTFISIQVQCSVNKKSIRLSRMSEASLKKQVLRVAFFLDRNNNSWIADKNFQGEDRTMLRLWNELSTYQQYLISSCNNDVKILSELYGEFRQIALPYDEKLNLNFMPVIRSSSERLFRADDLKCSFSRWLGAEGEFAVCEYSGWGVSRLGKIEIFAEKPLTFDMAWKTVKMRSSGAYTSLFRDDVTWGLIPLDKWVGDKYFCMCTNKESGDNVIVTLPEKNVEKSIQIYDEGSAMLSFAEMTSIILNLMFMGAVAVSVGILGISCFVGLKEIIYFIFVSVDYMWPFCDTLLTTAVNCFFKGRTFLRRELKI

SEQ ID NO: 239 - protein, 422 aa, herpes simplex virus 6A
MITVFVACLFQCVSSLPAKLYIKTTLAERIGKLQTVIGIDNDIVFAYERLYEDLTLLNHTVVGETLFDLTGSLEEGKNSTVDRFLGHVVIREFHRLHAGLQYVSLRNFSVSELVCFVNNNTQLSGSYVFLAGNTTYVQIDLFNENRGFVHDLINLSSFLQNRSLHVLSFYARRFCVEDILNFYGKVVFGDSRHRPPQVFSKRDTGLLVCTARRYRPIGTNIQWSIQNQTVSDDHMTDDFIRTEIAGQLLYSYERALSRALSMTQRNFSCEITHKLLVTPALLTREDAFSFKGFVNPVKQSEDMFPRHNFPAPHRKKFNKLQLLWIFTVIPIAAGCMFVYMLTRYILFFVSGGCSLNPNRVLKRRRRNDEVPMVIMEVEYCNYEADDYMELHSVQKVRDNSIAVVCGNNSFDIERQSKISRNF

SEQ ID NO: 240 - protein, 389 aa, herpes simplex virus 6A
MAFTGDELARMLQFKDKMISSAGLALKFEKVVQEAMASGIVLQHITCIKVRICDNSDILSDRQLRSLLINGLYPFEGRMSMFGVTEEWEGASAAPERQVVFLLSSTGQVLGYEDGVVFYLSPTFSDFWTTAMEFSCQNAILSNFIAQKSRDEYIDQFQKYFTRMRHTPIFLTGVLPRRFQKVESSACVEEDARASMRPIQCDSFGVKDTFCRPTEELLQPSANKDVGGKVCMSLSCREDNSARHCTIYGLTETRGIKIMFSRHTQTDRSEVMCNAATQTGDVVDNSSETLFLGKNLVHQSILETEVKTTAKNTFDVSNPRIDSVYDTTVFGAMATDDVGCENVQGGASLAQEKPLKGYCITATPSECKPNIHWLKSPEKTVQESAAVLR

SEQ ID NO: 241 - protein, 293 aa, herpes simplex virus 6A
MKKLTMESLSVYIFVMGVCFTSNFTCEQKIVLIQEHKLRSICISTCYVNGVLAGNSSCVSVKTSYLINLAMLTNGFKAMRVGNITSISEKTAFLRVIINYYFRGVMLRALIAQRLPNAANLSSTVNCWLDDHSAGGVMTLFYGTERIVLNSSTEINASRWISDGQDANGTLNILNERVSLDIYFLSKICPQLSSEIYKKKVAHPKYFSLIKNDTKPKKFLRNTWRSAWSNWYKYKEIKEFLDFSSDYENFSEITYSMSAAGLFFLAGGAFTMLLLLCCLSMITRKHIVKDLGY

SEQ ID NO: 242 - protein, 285 aa, herpes simplex virus 6A
VSVFRVSSVVCHSRFCCENKVIFPFKQGSLLLCCPERLQLLGYVSVWGEETRDVCLTKTLVFAGEDEKFYGLDFVNETLYLLAETTERFAVLGLRRYDPVYREKDIRFLTKIDDVLQSLIDAQDNLWKFATIVYKNSGRHYIMKSCLENNDGVFVLFLTRKEDFPSRMEWNFFSDVYESMPYDGQVIGSIGKTLLYPKTMFVMMDLSGAIYGIDTIGTGIGSCVKIADDFESFLRQGIVRGYRRYKFFHRNINTVQEILPLCPHTSLGPTFSNNYIYDLSSEDDE

SEQ ID NO: 243 - protein, 110 aa, herpes simplex virus 6A
MDVWKRQRLQECRELCPLPVLMSLSNMFSKIEIVYVKYLFKMDFSTMYRYILPALTLSMTVTKSLVIEMLFILKRWEDIDQFFRLNIRKVNDCFIVAQFNHIPIKRWVLI

SEQ ID NO: 244 - protein, 870 aa, herpes simplex virus 6A
MDLQRHPIPFAWLDRDKVERLTDFLSNLERLDNVDLREHPHVTNSCVVREGDDVDDLKTLYNLLVLWLMYHYVLSKRKPDYNAIWQDITKLQSVVNEYLNSKGLNKGIFENMFTNKEKFESQFSDINRALLRLGNFIKWGSNVAIDTPYVNLTAEDSSEIENNLQDAEKNMLWYTVYNINDPWDENGYLITSINKLIYLGKLFLALTQSWSKLEKVAMSQIVITQNHLSGHLRRHDNFNIVYSHRVLQTPLTGQRVESFLKIITSDYDIIKSSLESHSASKAFSMSEIGPNSLMDFVPLRGDIHSNLTLPSMSIDTKKSSLDPARLKKSNSRSLDSFLRMQRQPKFLELDSVDNAGEKILLKEATLGGENVKATTPASSVSLMSGVESPSSFTSTNLDLPLSSFTSTNLDLRDKSHGNYKIGPSGILDFNVKFPPNAQLNTNGVDLLQDKTSIGSPSSGITDVVNGFANLNLHQNKSNVSPPWSRNTAANADFLDPVHRFVPEQTGTPFVLNNSDVAGSEAKHTTYSTETGVSPRNVFLIKDLRGKDGFRKQKQSDIPKSLTKERNDKAIMHSREVTGDSGDATETVGARNSPALRKIKQANDFFAGLNKKNDRDVLRGGKGNSKDLHSGGNAKKKEMSGKFNDDKEMTRNGQEPSRSLMGDARNAGDEQYIQAGLGQRVNNLLSQFTNLISLGEKGIEDILQNQRGTELKLATENKSGRESEEANVEKILEVSNPQDMFKNFRLQNDLDSVQSPFRLPDADLSRELDSASFKDALDLKLPGNGEREIDLALEKVKVGETETSDLKVGQDESFVPAQLMKVETPEEKDDIIEQMVLRIRQDGETDENTVSGPGVAESLDIEAKGESAIAS

SEQ ID NO: 245 - protein, 104 aa, herpes simplex virus 6A
MAVRKLWKTVVQLFSKSKSEECNTEAGTMEVSFLKYGVRGLNADCSYVKSQCIKLSECECLYTFASDVCKEDFHNSEEMKVFVVQHSQEMVDGTDLFVHAEESV

SEQ ID NO: 246 - protein, 356 aa, herpes simplex virus 6A
MDLEAKEISGNIPNENALAELCRLCESADLSQIENFVGRYKNWCLSIIWPRNCWLRFTPRKDVAGYTEKMFEDMDDHYQGFVEKLCLLGTIQIPYRDVPILIGRSKRIFLHDLETDTLHFVCDNFEQFVRYGVLGTNIITCAEPVYRHGLYEGPRFESLENLMNNDVLRSPYTLNVHVKLNRKGVLGIKAMRKHYIAMLREFDELARCASLDDVGRFVSLNVGRDLRLDMPVFKSLTLGTRDSVWTGTCRLANLKEQEDLVEKVVVLGYLNDHDYESKCTRPILCIGKSGKIYYYDWIDNVLVKLGDCLLTFLRVGFARLFADYGYEKIGKISMRFGRMSTLGMSETYQSCMSLSK

SEQ ID NO: 247 - protein, 342 aa, herpes simplex virus 6A
MFQTEIVPVCNDEFALSSCVPTLDFDVDVLSAAYGDGLEISSPGLRCCIAWPPMYALTLGEFYHFHTHRWVSAYDWSSLLDADEFMSAVGYAHPIYRDPNPDYDPYVMHTSTGKTIAVDTVTEKVYIIAESLVQFFNIGLRQFPPFAEAELDPEQEKMWFGETKCGREEFILLQRNLPAMKDYVAKHSGKRIRVDAFQDFDFSFCSLSDIYYLTGPGILEKITEKDYAIIGTCARSQAEPNCRAAIVMGSNCHIYIYVENKISKVSKSLRTFIRRGFDELLYKEKYSLDWSDDTLFYISDTETENLNRMLNGELPVLRSKPRHMCVRKDRWVDVFCVVFQRG

SEQ ID NO: 248 - protein, 444 aa, herpes simplex virus 6A
MVKDLKFMDNFNEKWQCITKLAFLGLYAGASLFNFTSKPTLGYWCRYLSEYASMLLFQFESKLKELTKESTRQLGGYNLCHWGQELKDCLENKSDVFFRYDFFERIESCLIEHFMLLCGCVECRRMFIMYNKRGRKFDFGHSVRIQCFPMIGSIRLPAFLHLGEPYDVSLSSLIAKDLGLSMIEGQIELSRLPISLQISVTPDKKALLTFLTNIVFIVFVVNTLYRVINAELDIYYDLFTEEVGKLCVAMEEEMKLGRNGCLGDLCYFSPMKQMKEIVRCPGEKSQFILKCWEALRIGFSVPAYKDYDETPFMEMFFMHHLHIKRFHEDNDRDLVSCDNLIPGFFIVNTDGENFLQRLQRVVLPVVEDYLTNTRCINGTMAFFFSGLKYFGSGNHRGFQISPEKDVRAIAYKLGSLDVLRDDYKYYEYTPPDCPGELNGHGGDE

SEQ ID NO: 249 - protein, 535 aa, herpes simplex virus 6A
MELLDHDIYKGPVRERVTYTIPNHPYLSLTVHHSRELDVDLKDITEEMIIDSGTLTAEDLFMTRGLRFCDDSVLWAALAEKVSVEFQRRGKTTMDLSAFMSLLERLTFEDETSVFYRLLTKCTALAHFSILEYIVDGEKRDTISAHFNRLLELLDSLFLQFLMLRNRSESNTLLTLFDILPNPKEIYGDAASPTSVLLKHFLSDHIFVAYASSYRFVSSVLCSCDQCRASLFRIYLGKKDSRAVHISDISEFDPADLILGQLHLDAREAVALRAEIDRDLGSSLILNSMERRHLPILHDKQLGRGHFERNILKVYCNIVLCLFLLRRVKQRIVSDLTAIARFFVKAISEMERCIDTVSGLRGVRIKLLVVSSQFEIKDPMRVPRLCFFFLEIVAILVSGYDKERHRVRALLEHLCLKKICLGDLCASMRLAREIRHDVLEGFLNTLELSYMSNPVRFFRFHDCNLYGTHMWSGVYPNVVPYAVRGGGSFDIRLQEHRRRQKRIVVRRRLIRRVQQRGLDIREARRVPKPACVTFI

SEQ ID NO: 250 - protein, 373 aa, herpes simplex virus 6A
METTKNRRVRFTGGLHEPAQDSTMCGNAELQSRERTKTRQRVYNESKRDLVDLLRVYTCLNSVRMFTFVNFGRRIPLAWPEGYQLVINNCRDENEYADEKLDELAGLVCCPERLVVLGYVKKRGGIGSEPCYWFSKGDIVVLLGGAGRVYAHTWLLPQQLCRVGDTIDDFLRKGLKRFYYAHQLVSSLQFVVEDPEVDGVRSCRDVLCFRDRHIGRSFALRWPKNETLLFHRRRDSFAFVMCDEARRRLAEMCFFGSFGYKYFGDEGRISLYVADDGQIFGFNDNDEDGRPRFVAEDFQQFRRIGVTQYYKSYVFRREQPEWALLPTCHLSRMFYQKTWRQADADVLFLIARNDERNKFPDAGTRSAVHDVVR

SEQ ID NO: 251 - protein, 366 aa, herpes simplex virus 6A
MFCGSPFLGISSWSLASAALCPPSCSFSAGRDLRCDAEVPEVKWTAFVRTLVTRPLSADDVWDFVSTFAHCRLALSWPVGAELRFATSDMLGITQAEVAKLSRRYGCCPGMDLTVIGVTIFAEVSALVLVGECGEIYAFNGVFDDALYRLAEDAFGLWKHGLRRFEPVYGSKCLTETGASFFGGMSGVDDVLAFAVSFDKALVPLPWPRGAFFEFAVPGRPEKRWRLIPGGGVAVVIGRFFGRGVTSPLLRRQRVLMDQVGRVYAASLDGGAVVRLSDSFRAFLAMGVRKLFKNHRFPPGHLWTMQLPVTCVHAPVIDLPAVYQLSPHMVERGMPVASCEASTVVRGDCEETETEESTSGDSVLVC

SEQ ID NO: 252 - protein, 321 aa, herpes simplex virus 6A
MSAERSTARRGVSTRVRSTPSLARAGPPRERPRPFSLLRRILVCPLRLCLPSLSLSPSLAGAIGSSRSPSPLNYAPSAPIPSSALSGGAGGGSRIHDTRVFRARRLGPQPMGSFFHASRSGARVGEKHGASHSGVRARVGGWVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVRVSRWFPLAPCQATVGPRRWHVARDVVLNCLHVSPRYAPSTYPPATTTWVGCACLCVCVCTRPW

SEQ ID NO: 253 - protein, 145 aa, herpes simplex virus 6A; identical to SEQ ID NO: 191

SEQ ID NO: 254 - protein, 192 aa, herpes simplex virus 6A; identical to SEQ ID NO: 192

SEQ ID NO: 255 - protein, 112 aa, herpes simplex virus 6A
MARVMTRGMARVSTLATVRVSTLARARFSVRDSFMVSVIVGVRVRVDVLVRVNVLVRARPRVRVRARPRVRVRVRARPRVRVRVRASPRVRVRVITPPFFSPPGGFDVIFKT

SEQ ID NO: 256 - DNA, 1091 bp, herpes simplex virus 6A
  CDS (1)..(163)
  CDS (316)..(1088)
atggcagacgaacgaaccagcgattctgttaaaactcgttatgatattgcactgatgaagctaaacgatataaaaattgcagtttttcgtgattctctatcgacatacgtagaacagaagaccggcttaactatacagtttaattggccgaaaagtcgatgcttggtgatttcgacactgtgtaaaattccatttcccacaaagtctgccgcagagttgcaagaaatgtgtaagtatcagtgtttcgtgtcagttctgtggtgtgtcattctcgtttttgttgtgaaaataaagttatttttccttttaaacaaggttcgttattactttgctgcccggaaagattgcaactacttggatatgtttctgtctggggagaggagactcgtgatgtgtgcctaactaaaacgttggtgtttgcgggagaagacgaaaaattttacggtctcgattttgtgaatgagacactgtatctgttggcggaaacgacggaacgatttgcagttctcggattgcgtcgctatgatccggtatatcgagaaaaggacattcgctttctaacgaaaattgatgatgttcttcaatcgttgattgatgcgcaggataatttatggaaattcgctactatcgtttataaaaatagtgggaggcattacattatgaagtcttgcttggaaaataacgatggagtatttgttttatttcttactaggaaagaagattttcctagtaggatggaatggaatttcttttcggatgtctacgagagtatgccgtatgacgggcaggttatcggaagcattggaaaaacattactgtatcctaaaacgatgtttgtgatgatggatttatcgggggcaatttatggtattgatacgatcggaacgggaattggatcttgtgttaaaatagcagacgattttgaatcttttttaagacaagggattgttaggggatatcgtcgctataaatttttccataggaacattaacaccgtccaagaaattttgccgttgtgtccccatacttctctagggcccacattctcgaataattacatttatgatttatcatctgaggatgacgagtaa

SEQ ID NO: 257 - protein, 312 aa, herpes simplex virus 6A
MADERTSDSVKTRYDIALMKLNDIKIAVFRDSLSTYVEQKTGLTIQFNWPKSRCCSLLLCCPERLQLLGYVSVWGEETRDVCLTKTLVFAGEDEKFYGLDFVNETLYLLAETTERFAVLGLRRYDPVYREKDIRFLTKIDDVLQSLIDAQDNLWKFATIVYKNSGRHYIMKSCLENNDGVFVLFLTRKEDFPSRMEWNFFSDVYESMPYDGQVIGSIGKTLLYPKTMFVMMDLSGAIYGIDTIGTGIGSCVKIADDFESFLRQGIVRGYRRYKFFHRNINTVQEILPLCPHTSLGPTFSNNYIYDLSSEDDE

SEQ ID NO: 258 - DNA, 402 bp, herpes simplex virus 6A
  CDS (1)..(402)
atggcagacgaacgaaccagcgattctgttaaaactcgttatgatattgcactgatgaagctaaacgatataaaaattgcagtttttcgtgattctctatcgacatacgtagaacagaagaccggcttaactatacagtttaattggccgaaaagtcgatgcttggtgatttcgacactgtgtaaaattccatttcccacaaagtctgccgcagagttgcaagaaatgtgtaagtatcagtgtttcgtgtcagttctgtggtgtgtcattctcgtttttgttgtgaaaataaagttatttttccttttaaacaaggttcgttattactttgctgcccggaaagattgcaactacttggatatgtttctgtctggggagaggagactcgtgatgtgtgcctaa

SEQ ID NO: 259 - protein, 133 aa, herpes simplex virus 6A
MADERTSDSVKTRYDIALMKLNDIKIAVFRDSLSTYVEQKTGLTIQFNWPKSRCLVISTLCKIPFPTKSAAELQEMCKYQCFVSVLWCVILVFVVKIKLFFLLNKVRYYFAARKDCNYLDMFLSGERRLVMCA

SEQ ID NO: 260 - DNA, 2493 bp, herpes simplex virus 6A
  CDS (1)..(2493)
atgagcaagatggcagtattattcctggctgtctttttgatgaatagtgttttaatgatatattgtgatccggatcattatatcagagcgggctataatcacaaatatccttttcggatttgttcgattgccaaaggcacggatttaatgcggttcgacagagatatttcgtgctcgccgtataagtctaatgcaaagatgtcggagggttttttcatcatttacaaaacaaatatcgagacctacacttttccagtgagaacgtataaaaaagagttgacgttccaaagtagttaccgtgatgtgggtgtggtttattttctggatcggacggtgatgggtttggccatgccggtgtacgaagcaaatttagttaattctcatgcgcagtgttattccgccgtagcgatgaaacgacccgatggtacggtgtttagtgcctttcatgaggataataataaaaacaatactctaaatttatttcctctgaatttcaaatctataactaataaaagatttatcactacgaaagaaccctactttgcaaggggtcctttgtggctatattctacatcaacgtctctcaattgtattgtgacggaggctacggctaaggcgaaatacccgtttagttactttgctttgacgactggcgaaatcgtggaagggtctccgttcttcaacggttcaaacggtaaacattttgcagagccgttagaaaaattgacaatcttggaaaactatactatgatagaagatctaatgaatggtatgaatggggccactacgttagtgaggaaaatcgcttttctcgagaaagcggatactttgttttcttgggaaatcaaggaagagaatgaatcggtgtgtatgctaaagcactggaccacggtgactcacgggcttcgagcggagacgaatgagacctatcactttatctctaaggagttgacagccgctttcgtcgcccccaaggagtccttaaatcttaccgatccgaaacaaacgtgtattaagaatgaatttgaaaaaataattaatgaagtctatatgtcagattataatgatacatatagcatgaatggtagttatcaaatttttaagactacgggagatttgattttgatttggcaacctcttgtgcaaaaatctcttatgtttcttgagcagggttcggaaaaaatacgtaggaggcgagatgtgggggatgttaagtctagacatgatattctttatgtgcaattacagtatctttatgatactttgaaagattatatcaatgatgcattggggaatttggcagaatcttggtgtctcgatcaaaagcgaacgataacgatgttgcacgaacttagtaagattagtccgtcgagtatcgtgtctgaggtttacggtcgtccgatatctgcacagttgcatggtgacgtgttagctatctcgaaatgcatagaggttaatcagtcatccgttcagcttcataagagtatgcgggtcgtcgatgcaaagggagtaaggagtgaaacgatgtgttataatcggcccttggtgacgtttagttttgtgaactcgacgcctgaggttgtccctggccagctagggttagataatgaaattctgttgggtgatcataggacagaggaatgtgaaatacctagtacaaagatctttttatctggaaatcatgcgcacgtgtataccgattatacgcatacgaattcgacgcccatagaagacattgaggtattggatgcttttattagactaaaaatcgatcctcttgaaaatgccgattttaaagtactcgatttatattcgccggacgaattgagtagagcaaacgttttcgatctagagaatattcttcgtgaatataactcatataagagcgcactatatactatagaagctaaaattgctacgaatacaccttcgtatgttaatgggattaattcttttttacaagggcttggggctataggcactggattgggctcggttataagtgttacggcaggagcgcttggggatattgtgggtggagtggtgtcttttctaaaaaatccattcgggggtggtctcatgttgattttagcgatagtagttgttgtgataataattgtggttttcgttagacaaagacatgtgcttagtaagcctattgacatgatgtttccttatgccaccaatccggtgactactgtgtccagtgttacggggaccactgtcgtcaagacacctagtgttaaggatgttgacgggggcacatctgttgcggtttcggaaaaggaggagggtatggctgacgtcagtgggcaagtaagtgacgatgaatattcacaagaagatgctttaaaaatgctcaaggccataaagtccttagacgagtcctacagaagaaaaccttcgtcttctgagtctcatgcctcaaaacctagtttgatagacaggatcaggtatagaggttataagagtgtaaatgtagaagaagcgtga

SEQ ID NO: 261 - protein, 830 aa, herpes simplex virus 6A
MSKMAVLFLAVFLMNSVLMIYCDPDHYIRAGYNHKYPFRICSIAKGTDLMRFDRDISCSPYKSNAKMSEGFFIIYKTNIETYTFPVRTYKKELTFQSSYRDVGVVYFLDRTVMGLAMPVYEANLVNSHAQCYSAVAMKRPDGTVFSAFHEDNNKNNTLNLFPLNFKSITNKRFITTKEPYFARGPLWLYSTSTSLNCIVTEATAKAKYPFSYFALTTGEIVEGSPFFNGSNGKHFAEPLEKLTILENYTMIEDLMNGMNGATTLVRKIAFLEKADTLFSWEIKEENESVCMLKHWTTVTHGLRAETNETYHFISKELTAAFVAPKESLNLTDPKQTCIKNEFEKIINEVYMSDYNDTYSMNGSYQIFKTTGDLILIWQPLVQKSLMFLEQGSEKIRRRRDVGDVKSRHDILYVQLQYLYDTLKDYINDALGNLAESWCLDQKRTITMLHELSKISPSSIVSEVYGRPISAQLHGDVLAISKCIEVNQSSVQLHKSMRVVDAKGVRSETMCYNRPLVTFSFVNSTPEVVPGQLGLDNEILLGDHRTEECEIPSTKIFLSGNHAHVYTDYTHTNSTPIEDIEVLDAFIRLKIDPLENADFKVLDLYSPDELSRANVFDLENILREYNSYKSALYTIEAKIATNTPSYVNGINSFLQGLGAIGTGLGSVISVTAGALGDIVGGVVSFLKNPFGGGLMLILAIVVVVIIIVVFVRQRHVLSKPIDMMFPYATNPVTTVSSVTGTTVVKTPSVKDVDGGTSVAVSEKEEGMADVSGQVSDDEYSQEDALKMLKAIKSLDESYRRKPSSSESHASKPSLIDRIRYRGYKSVNVEEA

SEQ ID NO: 262 - DNA, 831 bp, herpes simplex virus 6A
  CDS (1)..(831)
atggctaacgtactcaaagaaaagatgtacgatgaactactgagtgcgacctgtcgtatcttaaagttggggtctcatgactataggataactgagcggaatctattgtcgaagaacccgaagtttcctttgtgtgatatcattctcaagttagactacgcttataatctagaatatctgctaagtctttgggaacatgtaactaagcaggaacccagatttgtgttcaagaacacaggtggagctgtgtcgatgtcttgctatttgcatgccccggttaaagtagaaggtcatcatgctgtgagagaatgcaacatcctgcgtgttaatgaatgtttgactgtccgcatgagcgacatagtggctatgaagccttcaacttttgcagtgttcacgaaatgtataatcaggcgtaatcgagacgacacttacgttgttgagtttgtggcgttcggacctgaaaacgaatctgaatacatttcgcttttgaaggcaattttcttaaagaagtgttctatggggaaacagcatctcgaatcaaataggttttgtcaaggtttgagaagaaggtcttcacatgttttggaaaaggggcgattcgaaagtagcgggaaagttgtaaataaagcttctgcggttgtgacatcacaggagagtataaagcagttctatgaaaaagagaagtcattactgtccggtgtgaagttttggagactaagtgaaagacattgtcggtttgcgcttgtcggcatctgttttcttttagccttgtatttttgttatgttctacttaaaaaaactcctacgccagcttctggctccgttgtgtaa

SEQ ID NO: 263 - protein, 276 aa, herpes simplex virus 6A
MANVLKEKMYDELLSATCRILKLGSHDYRITERNLLSKNPKFPLCDIILKLDYAYNLEYLLSLWEHVTKQEPRFVFKNTGGAVSMSCYLHAPVKVEGHHAVRECNILRVNECLTVRMSDIVAMKPSTFAVFTKCIIRRNRDDTYVVEFVAFGPENESEYISLLKAIFLKKCSMGKQHLESNRFCQGLRRRSSHVLEKGRFESSGKVVNKASAVVTSQESIKQFYEKEKSLLSGVKFWRLSERHCRFALVGICFLLALYFCYVLLKKTPTPASGSVV

SEQ ID NO: 264 - DNA, 1182 bp, herpes simplex virus 6A
  CDS (1)..(1182)
atgtgttggtcatttcatttgttttttaaagcacataaggcgcgagttggtgctaggacttcgttcttgacagagatggagcgcggtagtcgagatcatcatcgtgatcaccgtgatcatcgggaacatagagaaacgagagaaccgccgaccctagcttttcatatgaaaagctggaaaactattaataaatcgcttaaagcgtttgcaaaactgttaaaagagaatactacagtgactttcacgccgcagccgtcgataataattcagtctgctaaaaatcatctcgtgcaaaagctgactattcaggcggaatgtttgtttttgtcagatactgatcgttttttaacgaaaaccattaataatcatattccactttttgaaagttttatgaacatcatctcgaatcctgaggttacgaagatgtacattcagcatgatagtgatctgtatacgagggttttggtaacggcttccgatacatgtacacaggcgtcggttccctgtgtgcacggacaagaagtggtgcgagacaccgggagatcgccgttgaggattgaccttgatcattcgaccgtttccgatgtgttgaaatggctttcacctgtaactaagactaaacgctctggtaaatctgacgctttaatggcgcacattatagtacaggttaatcctccgactataaaatttgtgacagagatgaatgaactggagttttcgaacagcaataaggttatattttacgatgttaagaacatgcgatttaatctatctgccaaaaatttacagcaggctttaagtatgtgtgctgtaatcaagacgtcgtgtagtttacgtacggtagccgctaaggactgtaaattgatattaacttccaaaagcacgttgttgacggtggaagcctttttaactcaggaacagctcaaagaggaatctcgctttgaacgaatgggtaaacaagatgacggaaaaggggataggagtcataagaacgacgacggaagtgcgttggcatcaaaacaggaaatgcaatataaaataaccaactacatggtccccgctaaaaacggaactgcgggctctagcttatttaacgagaaggaagatagcgaaagtgacgattccatgcattttgactacagctctaatcccaatcccaagaggcagagatgcgtcgtctga

SEQ ID NO: 265 - protein, 393 aa, herpes simplex virus 6A
MCWSFHLFFKAHKARVGARTSFLTEMERGSRDHHRDHRDHREHRETREPPTLAFHMKSWKTINKSLKAFAKLLKENTTVTFTPQPSIIIQSAKNHLVQKLTIQAECLFLSDTDRFLTKTINNHIPLFESFMNIISNPEVTKMYIQHDSDLYTRVLVTASDTCTQASVPCVHGQEVVRDTGRSPLRIDLDHSTVSDVLKWLSPVTKTKRSGKSDALMAHIIVQVNPPTIKFVTEMNELEFSNSNKVIFYDVKNMRFNLSAKNLQQALSMCAVIKTSCSLRTVAAKDCKLILTSKSTLLTVEAFLTQEQLKEESRFERMGKQDDGKGDRSHKNDDGSALASKQEMQYKITNYMVPAKNGTAGSSLFNEKEDSESDDSMHFDYSSNPNPKRQRCVV

SEQ ID NO: 266 - DNA, 348 bp, herpes simplex virus 6A
  CDS (1)..(348)
atggccgctgaatccaccctccgaggcaaagactcgacctgttccactataaaattgcaatttttgcttattttatcaattattttaaaaaggtcgtctttcgtttcacagttctcaaaatcgtcttttatcccgtttaacgccgaattcattcccctctcagagtatacgcggacagagcttcaatctgcttattgtcgacgagagccactttataaagaaagacgcgttcagcacgattttaggtttcctgccccaagcatctaccaagatcctatttatatcttcgaccaattccggaaaccattcaacatcttttttaatgaagctgaacaactctccgtttga

SEQ ID NO: 267 - protein, 115 aa, herpes simplex virus 6A
MAAESTLRGKDSTCSTIKLQFLLILSIILKRSSFVSQFSKSSFIPFNAEFIPLSEYTRTELQSAYCRREPLYKERRVQHDFRFPAPSIYQDPIYIFDQFRKPFNIFFNEAEQLSV

SEQ ID NO: 268 - DNA, 1989 bp, herpes simplex virus 6A
  CDS (1)..(1989)
atgcacagagcatcagcaaattcgctgttgaactcggtttcgggatccatgatgtggcgaaaccaatcttccggcagacgcccctccaagcgtctttctgataacgaagccaccttatctacaatcaactctattttgggagccgaagacatgttaagcaaaaacttattatcgtatctacctccgaacaacgaagagatagacatgatttatccctcggagcagataatgacttttattgaaatgctacacggacacaaaaattttttcaaaggtcagacaatccacaacgctctccgagattccgccgtactgaaaaaacaaatagcctatggagtagcgcaagcccttttaaacagcgtttccattcaacaaatccacgatgaatggaaacgtcatgtgaggtcatttccgttccacaacaaaaaattgtcatttcaagattattttagcgtatgggcccacgcgattaaacaggtgatcttgggtgatatatctaatataattaattttattcttcagagcatagacaacagtcactataacagatatgtagactggatctgtactgtaggaatcgttccgttcatgagaaccacccatacggccccgaacttatacaatctcctacaacaagtgtcatctaaactaatccacgacatagtgcggcataaacaaaacattgtaactcccgttttactgggtctatcttccgtgatcattccggattttcacaatattaagattttccgagaccgaaattcggagcagatttcttgttttaaaaacaagaaggctatagcgtttttcacgtacagcaccccatatgttattagaaatcgcttaatgctgactacgcccctcgcccacctttctccagaactaaaaaaacacaatagtctgcggcgtcatcaaaaaatgtgccaattattgaatacatttcccataaaggtgctaaccacagcaaagacagatgtaaccaacaaaaagataatggacatgatagaaaaagaagagaaaagcagcgacgcgaaaaaaagtttaatcaaatttttactcaacttatcggacagcaaatctaaaataggcattagggacagcgttgaaggatttattcaagaaatcactccctctataatagaccaaaataaactcatgttgaaccgaggacagttccgaaaacgctctgcgatcgacacaggagagagagacgttcgagatctgttcaaaaaacaaatcatcaagtgcatggaggagcagatacaaacacagatggatgaaatcgaaacactcaaaacaacaaaccaaatgttcgaaaggaaaatcaaggatctacactccttgctcgagacgaataacgattgtgatcgctataacccgaatctggaccatgacctcgagaatctctctttatctcgagcgctaaacatagttcaaaggctcccattcactagcgtttccatagatgacacccgatcagtcgcgaacagttttttttcacagtatatcccagacacgcaatatgccgacaaacgaatagaccagctatgggaaatggaatacatgcgaaccttccggttaagaaaaaacgttaataatcaaggacaggaagaaagtatcacatactctaactatagcatcgagctgctcatcgtgcctttcctaaggcgattcttaaacatttacaacctcgaatcgattcccgaagaatttctctttctatccctcggtgaaatcttattagccatctacgaaagcagcaaaatcaagcattatttaagactcgtatacgtccgagagctaaatcagatatcagaagtgtttaatttaacccaaacgcaccccgaaaacagcgaaccgattttcgattcgaacattttctccccaaacccggagaatgaaatccttgaaaaaattaaaagaattagaaacctcagacgtattcaacatcttacacgtccgaactatcctaaaggtgatcaagattga

SEQ ID NO: 269 - protein, 662 aa, herpes simplex virus 6A
MHRASANSLLNSVSGSMMWRNQSSGRRPSKRLSDNEATLSTINSILGAEDMLSKNLLSYLPPNNEEIDMIYPSEQIMTFIEMLHGHKNFFKGQTIHNALRDSAVLKKQIAYGVAQALLNSVSIQQIHDEWKRHVRSFPFHNKKLSFQDYFSVWAHAIKQVILGDISNIINFILQSIDNSHYNRYVDWICTVGIVPFMRTTHTAPNLYNLLQQVSSKLIHDIVRHKQNIVTPVLLGLSSVIIPDFHNIKIFRDRNSEQISCFKNKKAIAFFTYSTPYVIRNRLMLTTPLAHLSPELKKHNSLRRHQKMCQLLNTFPIKVLTTAKTDVTNKKIMDMIEKEEKSSDAKKSLIKFLLNLSDSKSKIGIRDSVEGFIQEITPSIIDQNKLMLNRGQFRKRSAIDTGERDVRDLFKKQIIKCMEEQIQTQMDEIETLKTTNQMFERKIKDLHSLLETNNDCDRYNPNLDHDLENLSLSRALNIVQRLPFTSVSIDDTRSVANSFFSQYIPDTQYADKRIDQLWEMEYMRTFRLRKNVNNQGQEESITYSNYSIELLIVPFLRRFLNIYNLESIPEEFLFLSLGEILLAIYESSKIKHYLRLVYVRELNQISEVFNLTQTHPENSEPIFDSNIFSPNPENEILEKIKRIRNLRRIQHLTRPNYPKGDQD

SEQ ID NO: 270 - DNA, 2493 bp, herpes simplex virus 6A
  CDS (1)..(2493)
atgaaattatccggactatactgtgatgcggacatcacacacacacaaccgttgagtgataatacgcatcaagatcctatatattctcaagaatccagaatattttcaaaaactatccaggatccactagtagctcagacccacagacaatgcacatcctctgcttccaatctacaatcaaacgaaagcggttcgacccaggtgcgctttgcttcggaactaccgaatcaactcctacagcccatgtacacgtcacataaccaaaatgcaaatctacagaacaatttcacctcgttgccgtatcaaccttatcatgatccatacagagatatagagagttcctacagagaatctagaaataccaatagaggatatgactataactttagacatcatccgtataggcccagaggaggaaatggaaaatataattactacaatccaaactcaaagtatcaacagccatacaaaagatgttttaccagaacttataacagacgcggaagaggccacagatcatacgattgctcagacagatccgcggatttaccatatgaacattacacgtatccaaactacgaacaacagaatccagacccccgtatgaataactataaagattttacacaactaacaaacaagttcaattttgaatcctatgactatagcatggcattctcaacagactccacacacgtacaatccgacaattacaatcatccaacaaaagcacagacaataccagaaactacaaaaactaaaaaacatgaggctactaaggataacgaaacatccacagaaaatcaagttttaacgcctgacgtaatcagtttatcatacagacctagttcctacaaaatggatattattaaaaaaatatatgacactgacgttattccgttaccgaaggaagccttaacagccaatggctcaaatcgtgacgtggatattcagaagtacaaaaaagcacatatccgttgtagatcagtccagaagaaaaaagaacgcagttctcaaacaaacaaacatgatgaaaaccatgcctcatcacgttctgatcttaaggagagaaaatctaatgagaatgaagataaagccgttactaaagctagagatttttcaaaattaaaccccctattatctcctcttccgttgacacctgaacccgccatagactttgcggaccatacagataaattctattcgacaccagaattcaaccaaatacaacaaaatctacaccgatcaaaaacttctctacaagacacagttcccatatcaaaacatactccaagagccccgaccaaagataattcttacaaaaaacatcatgactccaaagacaattatcctaaaatgaaacattctcctggacgtacaacatctaaaaaaaatactacaaactccaacggacaccaaaactttaaggaagtatccgttaagaatgtttcagggaaagccacatctacatcaccaaaatcaaaaacacaccattattccagtagctctgatgaagaaggtcaatacaaatctccggtaaaaactattatccaatcaccttctccatattgcaagttaaaaaatccttcaattatggacaagaacagtgctaaaaaccacactgcaagcgccgacaaaaatttaacagacaattcacctattcggagtaatttaaatcctactgcttttaacaaatccaacagtaacaaaagcatcacggatagcacttctaacagtgatgagtgtactgacaggaaacctaactgcaattccaccaaaaatgaatctaaagatcctaaccgaacttgtggcaaaaactctgataaacatctgagtaaaagttgcaccatggcttctaaaagggctcccagcagagcctcaagcagagcctccagcagggattctagcagggatcaagcagagcctccagcagagcctccagcagggattctagcagagcctccagcagagcctccagcagggattctagcagagcctccagtagagcctccagcagggcctcaagcaaagcctccagcagagcctccagcagagcctccagcagagcctccagcagggattctagcagggcctcaagcaaagcctccagcagagcctccagcagggattctagcagagcctccagcagggattctagcagggattctagcagggcctccagcagagcctccagcagggattctagcagggcctcaagtaaagcctcaagaaaagcctccagcagagcctccagcagggcttccagcagggcctcaagcaaagcctccggtaaagcctcaagcgaagcctccagcagagcctccagtaggaattctagcagggcctcaagcagagcctcaagcagagcctccagcagggattctagcagagcctccagcagagcctccagtagggattctagcagggcctcaagtaaagcctcaagaaaagcctccagcagagcctccagcagggcttccagcagggagctga

SEQ ID NO: 271 - protein, 830 aa, herpes simplex virus 6A
MKLSGLYCDADITHTQPLSDNTHQDPIYSQESRIFSKTIQDPLVAQTHRQCTSSASNLQSNESGSTQVRFASELPNQLLQPMYTSHNQNANLQNNFTSLPYQPYHDPYRDIESSYRESRNTNRGYDYNFRHHPYRPRGGNGKYNYYNPNSKYQQPYKRCFTRTYNRRGRGHRSYDCSDRSADLPYEHYTYPNYEQQNPDPRMNNYKDFTQLTNKFNFESYDYSMAFSTDSTHVQSDNYNHPTKAQTIPETTKTKKHEATKDNETSTENQVLTPDVISLSYRPSSYKMDIIKKIYDTDVIPLPKEALTANGSNRDVDIQKYKKAHIRCRSVQKKKERSSQTNKHDENHASSRSDLKERKSNENEDKAVTKARDFSKLNPLLSPLPLTPEPAIDFADHTDKFYSTPEFNQIQQNLHRSKTSLQDTVPISKHTPRAPTKDNSYKKHHDSKDNYPKMKHSPGRTTSKKNTTNSNGHQNFKEVSVKNVSGKATSTSPKSKTHHYSSSSDEEGQYKSPVKTIIQSPSPYCKLKNPSIMDKNSAKNHTASADKNLTDNSPIRSNLNPTAFNKSNSNKSITDSTSNSDECTDRKPNCNSTKNESKDPNRTCGKNSDKHLSKSCTMASKRAPSRASSRASSRDSSRDQAEPPAEPPAGILAEPPAEPPAGILAEPPVEPPAGPQAKPPAEPPAEPPAEPPAGILAGPQAKPPAEPPAGILAEPPAGILAGILAGPPAEPPAGILAGPQVKPQEKPPAEPPAGLPAGPQAKPPVKPQAKPPAEPPVGILAGPQAEPQAEPPAGILAEPPAEPPVGILAGPQVKPQEKPPAEPPAGLPAGS

SEQ ID NO: 272 - DNA, 161573 bp, herpes simplex virus 6B
  CDS (576)..(842)
  CDS (1027)..(2970)
  CDS (5025)..(5336)
  CDS (6512)..(7150)
  CDS (7928)..(8662)
  CDS (8929)..(9384)
  CDS (15395)..(15652)
  CDS (18386)..(19897)
  CDS (23699)..(24022)
  CDS (24136)..(25953)
  CDS (42839)..(46087)
  CDS (46105)..(52338)
  CDS (55212)..(56660)
  CDS (56664)..(57458)
  CDS (74335)..(75030)
  CDS (76180)..(76434)
  CDS (81342)..(82100)
  CDS (83642)..(84547)
  CDS (85350)..(86936)
  CDS (95048)..(97366)
  CDS (97375)..(98415)
  CDS (99551)..(99814)
  CDS (100390)..(101718)
  CDS (103591)..(104652)
  CDS (104999)..(106690)
  CDS (106698)..(108164)
  CDS (109475)..(111817)
  CDS (116250)..(118724)
  CDS (121322)..(122359)
  CDS (122640)..(122942)
  CDS (124657)..(124998)
  CDS (138630)..(138974)
  CDS (144230)..(147868)
  CDS (153618)..(153884)
  CDS (154069)..(156012)
  CDS (158067)..(158378)
  CDS (159554)..(160192)
tcctcgcgtttcaaaaattactttaaactccccgggggggttaaaaaaaggggggtattaaccctaaccctaaccctaggcctaaccctaaccctaaccctaggtctaaccctaaccctaaccctaaccctaggtctaaccctaaccctaaccctaaccctaggtctaaccctaaccctaaccctaaccctaggcctaaccctaaccctaaccctaaccctaggtctaaccgtaaccctaaccctaggtctaaccatagccctaaccatagccctaaccatagccctaaccataaccctaaccatagccctaaccatagccctaaccatagcactaaccatagccctaaccctagccctaaccatagccctaacactaatcctcgcatctggccctaacactacccctctttcaaccactcaccatcaccccacccgctgcccccccccacacacacacacacacacacacaccgccaccgctaccaccacctctgaacttcaccttttccctccatctcgccccacttctctctacacttctccgcccctctattcttactcctgttttctaggatgccgctgccggcgcgtgtcagccacgccctgcatcgtcttccgctgtcccactattggtggctactgttgggtcgacactcccttcgtcatgtccattcctaccttcgcctgcacaaaggtctacgccttcctttaccttggcccgagcaagaatgcctgcatttacatcctaagccttacaagtttctcctgcgttacccttgtctaacaagacaaccgcatcttcttcagggctggcccgcggattcttctctatgtgagtgacatttacacttccacttgttcacatgatttattgtgttttgtctgctacaccaagcacatttcggtttctcttttatacatttgtctctattctctcggtctcagggttcgaccctaaaccctaccatcttcggccgacagcaagttgctaccgctgggcctgatcacgctgtccgccttttccatgcgcgtttctgagccgacacactgcagcggcttccacgcggcacatccgtctctcagttggttaacgggatcgtccccttggctcgtgctcctacaagcgccaggagggtctctgttctgccacgacgtgttccaaggccgactctatctcctgtcgcactccgtgtcgctctttctaaagacgggccttcgccagtgtgaggccatctatcgcgcaccgctgtggcgcgtacggcccctgccgagcctatggacgtgtcgagatcccgacacggccttcttgccgaaattactggcgagaaccgcccgacgcggcctggccgctttctatgccctgtggagactgcatctgggatcccgctcggagctctctcaccccgtgttggagtgggagagaacagagctggtcctgacggatcggagacgcaggtggccgtgtacgcacctcctgtccggctcggagttccagcgcgtttcctcgagtgacgccggagacacatggaacgcagcgacagagaaggcggcggggggaaaagaggaggcggagagaggcgggcgacagcaagccactgacagactcgcaagtccgcacctgacgcggggcctccgcgactccggtcggtcccttcagggtgaggagcccagcgccgcggaagactttgcgaggtgcagaccgctgctggacgaactgtgcggggagggcggctggcttccctttgcgtttctcacggcatctccgcacgtctgtctgatcctaacggagggaggccccgtcctggcgcttgacctgaacgacacctccctgtggcgcatcgcggacgacttggagctgctgctgcgcctggggagcctgctcctgctctcagggctccggcttcctctccgtcccccgagcgggagcggcgaggcggcgagaaagccggggtacgagaaggaagagggaagagggagagcggcgacggcgagcgcgacggccgcgacgtcgccgcgcagaccgacccgtccgaggggggtgacggagaagggacgtgtgacaaccggggacgtccctttctccgcacatcccgaatctgaggaacagacagacggccaccacgggcgccaggaaagcggccacggcgaccagcgcggcggggacggacgaggacaccgcgatgacggcgcgcgccgccacgcgaatgacgaaacagagccccagcagcgcggagagcacgaggacggggaacagaccgactccgggcgcgaggaggacgcacaggagagcgaggtcgcaagaagagacgagaagggaacggagcagggcggtagcggaaggagctgcgggagggcaaagcagacgtacggcgggagaggcgaacatggtgcctggtcgtcgatccccctgtctgtccccaggcccgatccccgcgtgtgggtccctcctcctcatctgttattcccttccccgctgccgtcgataacgcccgtcgaagacgagccgtccgcccgccctcggtgcccgccaggtcccgcggaggaaccctctaagtgttctccgtgcccgccctgcccgtcgcccgacgccccgcagtccgctgtcccgcgcctctccgctctgtccgtcccctcgccgtccaccgcgcgtgtccgtttctccctctcctccctctcctcctcctcctcctcctcctcttcctcctcctccccgtcctactctccctccccgttgtctccgccctctcccgtctctccctcgtctcccagatctccgttcatctcccccattagatctccgggactccgagcaaagccgcgggtgtcctccgggcatcccgtggcgttcccgccggcgccctcgtccgcgccgcccttttccaaaagagtcccgtccgttccctcatcggcatctccgtccgcgccgtgcatcggcaggtcgcggccgccctccgcacagacggcgtgagacgccgcgtgaggtgacggaggcggcgaagggacacgagaagaacatgcagaagaacatgaagacgaagaagacgaagaaacgaggacgaaaggaggggaatacaccggagaccgagcggcggatggagcccgctcggttttgcacgtccgcgataccgagcggactccgtcgccgctccggaccctccacgcccctccgtccaggacccgaggtccgacacgcccccacctcgcgcacctcctccgccaccaccgctgacagtcaccgcatatcacccccatacacacccagcagcagaggccggcgcacacacacgcgcggagcacgcacgagaacacgcgagacatcggccgccgaaattaacggagtctatgcgcgcgccgtgacacggaaaaccaagcggagcgagacgatcgaccgactcctgctatccttcctccctgggtacggtccacacgccagtctgcggagtcacctgagggccggatccgctccgcgccccccgcccgatccgccccgataaaaaaaaatcatctgactcgtgccagttcacacagatgcaaccgatgacaaaaaaaaacacaccaccacaagcaaacgctcgccggcccgttcaccgtccctctcacccccactcgaatcgcgcaggcgcgtcggcgggcagtcccccgaacgcctccacggcaacgctcctcccacgccccctcggtcccccccccccctccctccatccccctccccggagcatacacgccgactctctccgcagaggcggcgaccacagcggcagcggaaactgtaacggccacgttctttgaacagtgacagtaacggcggcggcggctgtcgccgtcacggtagtcgtggcggagcacccggggaggcgacgacggggactaccgatgctctcagatcatcgccatagtgaaagagtaccgaataaaacaagttaaattttgttgtaaataaaaaaaaaatactatgtggaaattaaaaataaaaaaaaaatgaaaataaaggctaaacactgactaaacgtgcatccttctccgtacgtcccctttcaataaatggcggacccgacctctccataaacggagacacgccgggagactccggccctcccaatccacaggtagcccgagacctaatcacaaaactgtacctgaaaccgaaagtatagagggcggcctcgaatgccccacctatgaggcgggacttcgcgacgcgccacccttcctatacgcccggccttccgcgtgcgcgcctataggacgcatcccctcgccccgaaaccgcaacgcggcagagtcggcgccacacccccgtcccccgagttcgcgatgggctggcgccgaccctgccgcggcaacgaaggcgaaacgagaccccgacgcatgcgggcataaagagcgagaagtaaacgcggggtcccgaattatcgcgagactatttgcccgggcccgccctcgtcctcatgcccttccccccgccctcatcccccgacacacccggtgggaaaaacgaaagacacataaataaaacgaattttgttgttaaaaatgtttccacgtgacgtccccggtgattcccggagatgcggcacgcggcggattcgcccgtttacatcggggtccgcagacgcggttctgccagggcgttgcggtgtcggttccgcacagaacaccgcggtccgtcgtcaccgttcaaccgcgcggtagttccgcgattctatggttcatctccgctcacagcgttctctttcttttatttttcactgagccgctccaccaccaagagtgttactgactacaccgtatacatgtttttttatctctccacccctccccatcacagaccatcaaacaccttgccgtatcgacactgactatactcgaccgcggatgacaacggtcgttggtcacaacaagagctacagcggacagcaaaaataagataaatacagtaagagagaggccccggtccacataggaagccaagggcggacgaaaataaaaacccgtccgtgattcacacacgaatcgggggttatgacaacgcgacacacgcagatgagggacggacgcatcgcgatccggcgcgacggggcgcgattggcccacgcgcgagcccgtgcccgcttcgagtggctgctcctggctcgcggcaggccgtccaaactgtacggctatacgagtcggcaccggggagaacggatccacctaccgtggccgcggtactggtgcctagaactccatccggatccgtacagggacgccaggagcgccaccgtgtggggtcaccgctggggttggccgccaacgcacgtgagacccagatccgttcaagactgcggtgagtgagcgccgccgcgaccgacgacgctatgcgcacacgggcgagcggcggggagggacgtcggccgcagggcgagcgggtggagggcgagcgggtggagggcgagcgggtggagggcgagcgggtggagggcgagcgggtggagggcgagcgggtggagggtgagtgggtggagggttcgtcgaaaaccaccgaagacattggctggcggagagtggggacaaaacaacgtcacgtcaggggcggagaaatatagggtgcgcagaccgtcaaagcgcgagttacggaaaacgagtacggatacacggggggggggggggggaaggaaacatggtgaagtctgtgacacgcgtgaccgtcagccggcaacgcctgccacggcctccggcctcacagacgactcacggagtttcctccagacattgttttttttttttgtattcatcggtaatgcggtatacgtaaattccccgcaaaggtactttccgttaaggacggtacaggcggtatgacttccggaacacgatgattacggatatcctgcatagtgtacaggagaccgcttttttttaggttccgtataaaacgtacgtcggcgacgtacacacaacggttaaaaaaataaaaaaaaaagaggaaacagtaaagctcctcctttcctctgtgttatcgcgttgagttagtagtcgccattgctgttgcgtatgcttttcgcgttaacggtacgcgacaggatacgaatgcgttacacgccgcaaaggcatccctacgatgactctatgcggcatctcccgttcgcgcagaaacgcgagttcccgggacgccagtcgtgacgtccggccgatgggatgcctttgcgtgtgcggatgttttctgctgttttataggaacagagacaagagacgaaaatagcggaacgcccactataacgtgcatttttctctgtgttttgcgttttcatgttttatgattcttctacggtatcggccggaacggtcatcctcgatccttctcgtacgcgtgtcccgccccagccctggactcgagtctgtacgtatgttgcggatacggagaaaaacttcaacccgtgggcttcgtaagctcgtatctgacccactccccgctcgacacgcttcgcgtgctcctggtcggtagagacggagccgtgtacgtccaccacatgagggcggccagactctgccgactggcgtcgaacgtaacggagtttgcaaggcgagggctgcagcgggaccccgtggcgtatgaggaggacctagagctgccggaccggcgtatgtgcggaacgaacgtcagacatctgttcgacgtgatcgccgcggccgccgacgaacacgacctgctgaccgtcggcggcctgtgtcaaacgcacgccggagtgagctgtgaattactagagaccgtgcgagatccgtggacggcggttccgggcgtacgcatgactctgaccgtggcgcgggctcagtatcgcttgtggcccgatgcccggagacagctccgcctgcacctgtacgcgggacaccccctgggaccgtggatagtgtgcgccgttctgtctcgagagagggagacgcagacgccgtcgcctccgataggcagcggaggcgtgactctgggaaacgtgcccacgccggggccacgcgaagtggagacggcttgggtgatcgtcacctggcgggaccgctgttatcgttctggcccgataacggcaagatctgccgtctggcgaactcgttcgccgccctgtggaggatgggccgcgggccatgagaggacattggacgtattcggccccgggtagacatctccccgggaacgcttggccactcctgtgaacacgtgagaccgccggtcggaaaacttccccggcaaagagcgtacctggattagacgccacggcggagacgtaaggatgcgatatacggccagagacatgaccggaggaagatcatgacaaggatctcgaaatataaaacaaaaaaaaaaaagtgaggagtgcgcaaacgcaagaaaagaaaaagcagaaccgcggtggagatgtctatccgcctgcgtgtatgtgtggggtgtgtatatgtgcgcgtgaccgtatccctccctgcctttaacccgatgagaaataaaatcggcgaatgtacacaatcacacacaatgtgcttacgttccgtgttactgacaccacataacaaaaaaaaaacatacttcctgtccgtgagacaccgccgccctctagcggagttgctatagcagcgcccgatgccaacgcgacacggtgagtcgcatagatcgggactgcttgaaagcgcgccacattcgccttttatatagacgccccggggagtgggaggagccaacatacacacgaggtcggtctggggttggagacgaacgcggaaaatcaacggcgtaaaaaaaataaaaaaggcggagacacatagccttggcgggaagacgataacaggttcaaagatagacagtgaaaaaaaaaaaaagaggagaccatgacattgaatacacgtgcggcggcaatccaatcaacgggacgtgccggggcgcaaaaaaaagtatacggaagtgcatgcgacagacagtcacgcggaccgacgacaaaggccgactcctagcatggcaactaggaaaaaaaaataagcaacgctgcaaaatactaacaaaggaaacatcccttcaccccctccctaccccgtctaccacaatacccccccccctccgtaatcacttctgtccgcgtttctcccacaggcgcgtgcacacgcagacacgcagacacgcacacaccacctctatggcagtcgcgggcgggcaggcggggagcatacggggggcagatgtaaagtcaatgaggaacggcatagcgcgcgacgtgccgtcgtctcggacccttgctattctggcacgacgccaagggaagcctctggcgcaatctataaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaacccatcccccaacgcgcgcgcgcgcgcctctatgggaggcgccgtgtttttcaccaaaacgcgcgccactgcgagaggcgcgtgaaaaaacctcccctcccggacgggcccgagtcgtccgcgcgtgtcgccggtgcgccccgcgcccgggatccccccacctcccccccccaaagaacgggcgagggtatgggggtggatggcgtgtagtttaaaggcgaaggtgcagccgggcgccggagcccggtgagagcgaaaaaacgatggcgcgcgcgagagagaaagagaggcagaaggcagagccgcagagggacagacgaggagacgccggaggaaagagagaacggccgcgagggccatgagctccacctagcgtcagactacgccaccgcggccgcggtgcgctcgttcccgaggagggcccgcatgtggcgcgagagagggagaagagcggacgcgtgtagaaacggccaacgggcggatgcgcagagcgccccgccgggcgattgacctttccacagacccccgacccatttcggtgatgcagatacgcacgcgaacacgcacagacatgcctacgcggcctcaccgagcagactgccacgtgagcgaaagcatacacacacacgaaaaaatacacacaagaaaatacacacaagaaaatacacacacacaaaaatacacacacaaaaaaatacacacacaaaaaaaaatacacacacacaaaaaaatacacacacaaaaaaatacacacacacaaaaaaatacacacacacaaaaaaatacacacacaaaaaaatacacacacacaaaaaaatacacacacacaaaaaaatacacacacaaaaaaatacacacacacaaaaaaatacacacacataaaaaaatacacacaaaaaaaaaccattttatttatgcgctgttctcacaatgttaacataggacaaagacaaccacgaaaacgaccacaacaacaacagcagcaacagcatcaactacagcaacagacgagggcaggatcacgaggtgtcaactcccgcatctccgtcgcgcaacgtgtcctcgcagtccctacggactacggtagaagccccgcaagagactgcggacatttcccgctctaccatgtgcggagaaagttgatagacggcaggtagatttatcacaggcgcgtgcacgcacgtcacgggcagctgcatggtccacagatgtcccggagggaatcgatggttcttgaagagttttctgacacccatggcgagaaacgccctgaagctatcggacaggcgcaccacggctcccccgtcgagactggccgcatacaccctgccgacctgatccatgagcacccgctgtcgtctgagcagaggtaaagtaacgccgcgtccgaagaatctgccgatcaccaccgcgacgcctccgccgggtatgagccgccacctcttctccgccctcctgggtacggcaaactcaaagaaagctccgcgcggccaaggcaacggcacgagagccttatcgaaagacacggcgaaagccagggcgtcgtcaactccactcatgccgccgaagaaagaggcgccggtttccatgagacacttggaaccgtagacgggctcgaagcgacgcaagccgtgcttccagagaccgaacgcgtcctccgcgagacggtacagcgcgtcatcgaacacgccgttaaacgcgtatatctccccgcactctccgaccagcaccagcgcggaaacttctgcgaagatagtgaccccgatgaccgtgagatccataccgggacagcacccgtatccgcgagacagcttggccaactcggcctgcgtgatcccgagcatgtcggaagtggcgaatctcagttctgcccccacgggccacgagagcgccaacctgcaatgggcaaaagtagagacgaagtccctcacgtcgtccgccgatagcggccgggcgacgagagtccgaacgaacgccgtccatttaacctccggtactgccgcatcgcaccgcaggtcacgtcccgcagagaaagagcacgaagaagggcagagagcagcagaggccagactccaagaagatatgccgagaaacggagagcgacaaaacattttttttctgtgcggaatccgagataaaattaaaaggataaaaaaaaaaaaaaacgataacggcagcgttaccggcagtctcacataaacgtctacgatcacgttaaggacgctacaactgttagaaacaaacaacgttgaatcgacatattcccgacgtcttccacgaaaatggaagtgaaccgaccgcccacaaaactgtgaacacatcccatccccgggtaaaatatacaatgatcccagacgtcaaaagcgcccgtaagaactcgatctaccacgcttccattctttttttttaaaaaaaaaaacctaaccttcaacgttagggcgaactatcgaactacgtcgtgcacggcactcctagtgccggcgtccggaaattcctgacgctcatcgtttctagcctttacaaacagcagatcatcgtcggcctgcctccaagttttctgataaaacattcgcgagagatgacaagtcggaagaagcgcccattcgggctgctccctacggaaaacgtagctcttataatactgaatgactcctatccgtctaaactgctgaaaattttccgccacaaagcgcggccgtccgtcttcgtcgttgtcgttgaatccgaaaatccgtccgtcgtcggccacgtagagagaaatccgaccggcgtccgcaaagtacttgtagccgaagctgccgaagaaacacatttccgcgagcctgcgccgtgcctcgtcgcacctgacgaatacaaaagaatcccgccgccgatgaaagagcagagtctcgttcttgggccacctcagggcgaaagaacgacctatgtgccggtctcgaaagcacagcacgtcccgacaactgcagacgccgtccacctcggtgtcctccaccacaaactgcagcgatgataccagctgatgtgcgtaatagaacctcttcagacctttacgaagaaaatcgtcaatggtgtcaccgacgcggcacagttgctgcggcaataaccacgtatgcgcataaacgcgaccggcaccgccgagcagaacgactatgtcacctttcagaaaccagtaagccggctccgatccgatctccccccttttcttcacgtgccccagtacgacgaggcgctcccggaaacacactagatcggccagtccgcccaacttttcatcggcatattcattctcgtctctacagttgttaataaccagctcgtatccttcaggccaagccaagggaattcgcctgccgaaattgacgaacgtaaacattcggacgctattcaggcacgtatagacgcgcaagagatcgacgagatctctcttggacttgttatagagacgtggacgtttcttcatcctctcctgagactgcagctcgtcatccccacacatcatagaatcttgagccggctcatgaaggccttcgataaatcgcaccgtagccgtagccaaaatctgccgttgcgccgaagaaacacgccggctgtttgtcgtttccattacgggctcacagcgacagagaaatagcactcaaaacttagtaagcaaaagttgcaactcgcaaaaaaaaatgaaagataatatagtcacaaaagaaacttgtcacaatgtacacccaaaaagaacgatatggatgatcacacgacaacggcaacaataatatcgtttttttttaaagctaaacaaagtgaaagaagcgtaccggttttccggattcgtctgtatcagataaaggtcacacaagccagcttaggaacgcggcgcgcttcgcgaatgtctaaccctcgctgttgcacgcgtcttataagcctacgtctgaggactattcgcttttgacgtctccggtgctcctgcaacctgatgtcaaacgagccgccgccggccacagcgtaaggaacgacgttcggatacaccccactccacatatgggtcccgtaaagattgcagtcgtgaaaacgaaaaaacctcaccggattcgacatgtaagataactccagagtattgaggaagccctccagaacatcgtgccttatctcgcgagcgagtcgcatggatgcacacaggtcgcctagacagatcttttttaggcacagatgctccaagagcgcacgaacgcgatgccgttccttgtcataacccgatacgagaatcgtcacgatctcaagaaagaaaaaacacaaccgagggacgcgcatgggatctttaatctcgaactgagaactgacaactaacagtttgatcctgacaccgtggaggccagaaacggtatcgatgcaacgctccatttctgagatcgcttttacgaagaaacgagcaatggccgtgagatcacttacgatgcgctgtttgacgcgtctcagcagaaacagacacagaacgatgttgcagtacaccttcaagatgttacgttcgaaatgccctctccccaactgcttatcgtgaagaatgggcaaatgccgcctttccatagagttaagaataagagaagaaccaagatctcggtcaatctccgcccggagagcgaccgcttcacgcgcgtcgaggtgcagctggcctaaaattagatcagctggatcgaattcggaaatatcagatatgttcacggcccgggaatctttcttacccagatagatccgaaagagagacgcccggcactgatcgcaactacagagcacagaagacacaaagcgataagaagaagcgtacgcgacaaagatgtaatcggacaaaaagtgtttcaagagcacactcgtcggagacgccgcgtcgccatagatctccttgggattgggcaaaatatcgaacaaggtcaacagagtattggactcactcctgttcctcagcataaggaactgcaggaagagggagtccaacaactccaaaagacggttgaaatgcgccgagatagtatccctcttctccccatcgacgatgtactccagaatcgagaagtgcgccagagcggtgcacttggtcaggagtcgataaaaagctgacgtttcgtcctcaaaagttaaccgttctaagagagacatgaaagccgagagatccatggtcgtctttccacgcctttggaattccacagaaactttctccgccagagccgcccagagaacactatcgtcacaaaatcgtaagccgcgggtcatgaacagatcctctgcggtcaacgtgccgctatctataatcatctcctccgttatgtctttcagatcaacatcaagttccctggaatggtgaacggtcagcgagagatagggatggttgggaatggtatacgtgacccgttctcgaacgggtcccttataaatgtcgtggtccaataactccatcactcaagtaagtatatatctgagacagcgtttatttttttgtcgcagaaaaaaacaaacgagcagaattcaaattgcaggagacggccacgtacatcacaatcgagaaaacacacaatcactcatccccatcatgtccattcagttcgccggcacagtccggtgcatattcataatacttgtaatcatccctgaggacgtccaacgaccccaatttatacccgatagctctgacgtctttctcgggacttatttgaacaccccgatgattaccactcccaaaatatttcaagccactgaaaaaaaaagccatagtcccgtttatgcacctggtgttagttaaataatcttcggcgacgggcaacactacccgttgtagccgctgtaagaaattctcttcatgggtattaacgataaaaaaacccggaatgagattatcagaagacaccaggtcacgatcattgtgctcgtggaagcgttttatatgaagatgatgcagaaaaaacatttccatgaaccgagtctcgtcgtagtctttgtaagcaggaacggaaaaaccgattctcagagcttcccaacactttaagataaactgactcttttccccgggacacctaacaatttctttcatttgtttcatcgaagaaaagtagcacaggtctccgaggcacccgttccgccccagcttcatttcttcctccatggtcacacacaattttcccacttcttccgtgaagaggtcgtaatatatgtccaactcagcatttatgacacggtagagggtgttcacgacgaacacaatgaaaacaatgttagttaagaaggttagcaatgccttcttatccggggtgacagagatctgtagcgaaataggcagcctactgtgctctatctgaccttcaatcatgctcaaccctaaatccttcgctatgagactcgacagactcacactgtagggttcacccaaatgcagaaaagccggaagacgaattgaacctatcataggaaaacactgaattcggacacagtggccaaaatcacacttcctgcctctcttgttatacatgataaacatgcgcctacactcgacacaaccacacaggagcataaagtgctcgatgagacaggattcgatacgctcaaagaaatcgtatctgaagaagacatcggatttgttctccaagcagtccttcaattcttgaccccagtgacaaagattataacctcccagctgccgagtagattcctttgtcaactcttttaacttgctttcaaactgaaataataacatggaggcgtactcacatagatagcgacaccagtagcccagcgtaggtttggacgcgaagttaaacagagacgctccagcatagagaccgataaaagccagtttagtgatgcactgccacttctcatcaaaattgtccataaatttcaagtttttcaccatgtcagcaatctgatcggctctgacgtaggtggaaggatacttgtaagtttcatactcataatctatcagtctgttccacactacgcagtccgaagagggatgtagtcctttaatgccaaatctagctgctgaggttccctgcagaccgttcgtcaacctagcgcaggagacgggaacgacaaacctgctggtagcgggcagtcgaccgacgaataccggcgtgagaaattttgtgataaatttaaccgtcggcgaatcctcttcgtccagacgcaccgcaaacagaattttgctgcggtctttcacgagcctgttgtaagaaaaaacaagttaacggagagtcttcatcctcgaagaattgtcttttcgggaaaaacgacacacaacacatctacccacctgtcctttcgcacgcacatatgccgaggcttactgcggagaacgggcaactccccattcaacatcctattaagattctccgtctcagtgtcacttatataaaataaggtatcgtcattccagtccaatgaatacttctctttatagagcaattcatcaaatcctctacgtataaaagtcctcaaacttttagagactttgctgattctgttttctacgtagatatagatgtgacagttcgagcccataacgatagcagctctgcaatttggttcagcttgagagcgggcacacgtccctatgatagcataatccttttctgtgattttctctagaatgccaggtccagtcagataataaatatccgacaaggaacaaaaggaaaagtcaaagtcctggaaagcatccaccctgattctcttgccacaatgttttgctacgtaatccttcatagccgggagattcctctgtaaaaggataaattcctctcggccgcatttagtctctccgaaccacatcttttcctgctctggatctaactccgcttcggcaaagggtggaaattgtctaagtccgatattgaagaactggaccagtgattctgctatgatgtacactttctccgtcaccgtgtccacggcaatggtctttccagttgaactatgcatcacgtatggatcgtagtcaggattcggatcacgatatatcgggtgagcgtacccaatggcggacaaaaattcatcagtatccagaagactgctccagtcataggcacttacccatctatgcgtgtgaaagtgataaaactcacccagagttaatgcatacatgggaggccaggcgatacaacatcgcaagcccggagaactgatctccaacccgtctccgtaagctgcagacagcacgtctacatcaaaatccaaagtaggcacacatgatgacaaggtgaactcatcgttgcagaccggtacgatttctgtttgaaacataaacgcaaaatgaagtacaatactttcacacaagactcgctttccgccctccgtttcaagtatcagacgaaaattcgacatgaactacttactgaggctcatgcacgattgataagtctccgacatgcccaacgtcgacatccgtccgaagcgcatggatatttttccaatcttctcataaccgcagtccgcaaaaagtctggcaaatcccacacgcaaaaaagtcagtagacaatcgcccagcttcaccagcacgttgtctatccaatcgtaataatatatttttccagatttccctatacatagaataggtcttgtacatttagactcataatcatggtcattcaggtaacctaacactactactttttctactaagtcttcctgttcttctagatttgccaagcgacatgtccctatccagacactgtcacgagtccctagagtcaaactcttaaaaaccggcatatccaatctcagatcccggccgacgttgagagacacgaaacgttccacatcgtccaaactggcacaacgggccagctcatcaaactctcgcaacatggcaatgtaatgtttcctcatagccttgatgcccaaaacgcctttcctattcaacttcagatggacattcaaagtacagggactccttaacacatcattattccttaaattttccagcgattcgaatctggggccgtcatacaagccatgacggtacacaggctccgcgcatgtgatgatgttagtacccaggacgccgtatcttacaaattgctcaaaattatcacacacgaagtggagagtatccgtctctagatcgtgcaagaaaattcttttagatcggccgatcaaaattggaacatctctgtaaggaatctgaatagtccccagtagacacagtttttccacaaaaccctgatagtgatcattcatatcttcaaacatcttttctgtatatccagctacatctttacgtagagtgaatctcagccagcagttccgaggccagataatagacagacaccagttcttatacgtgccgacaaaattctcgattcgagaaagatcagcagattcacagaaacgacacaattcggcaagagcgttctcgttcggaatctcacctgagacctccttcgcctcgaggtccatcttgaaaactccgaataacactagaagtgaaacaatgaaatatctgaaatataagacctcgatgcgagacgccgtcacatgacaggaaattggaaaaaagagagtggtgtgacaaactttattaaatttcaacccccgttttgactcacacgctttcctccgcatgtacagaaaaatccgttccaccaacgatttcctgcgaatgttggacaacaaacaccttcatttcctcggaattatgaaaatcttccttacatacatcagaagcaaaagtatataaacactcgcattccgaaagttttatgcattgcgatttgacatagctgcaatccgcattcaaaccttgcaccccgtactttaagcaggagacctccatcgttccggcttctgtattgcactcctcggatttcgatttagaaaacagctgtacgactgtcttccataactttctaacagccatcggcagatccacttcagaaaaaacgaactcgaagcgccactaaaaacagatggaaatagtcacatacaagacggcttcagcgagatctccgaccgtcacctggtcatcgggattcggacgagctatagcctcaattcaaaaaaggcatcaagaaaatatcaggaaacccctacgcttctacagcggtctcctacactgccttataaaacagtatgagcattgcctcgtcccgccaaataaatcaatacgtttcgacaaagggaagattgaagtcgcggccctaattctagatctcggacaccaggtacttggtcgtcagatacacgtccgacaacgtatctacagctggactagcatcacactccctaaactctttactcccagagaactttactttttagttgcctctccagaagacgaagacatcgtatttaatccaactataacaaagggagggtggatctcgggaagtttttcgtatcccgttgaatacagatcaaacttttcgctaaccggaatgtcggctaacgtattaatggtgccgttcgttccgtatagatacccactaaactatgctcgcttcatatcgtcaatagatctgatgatactaaacgaacaatttccggaacacgaatgcggagacatacagattttaaagcagcgaaactacctctacctgggagtcatcaaaaatcttacatggaaaaaaagcgtcaccggcacaggtcagacagctccacatagaatcctaaaagcttcgttcataggaagttggccggacacctccctgcctgacagagtagcactgcgtttctttaataacactaggtttacgatacactgccacgagttcgcaattaatattgaaaatctcggtctcgtcaaaaataaagagaaagtctttgggacactagccaccgtatgctgcgagcaaatcccttctctactaacgactgaaaatctaccgagatatttaatagttcagtttgaagtagtaacgcaaatcgaagatcccgaacccctgttattttccagtaacccgaaactatattttacaggagacgtactaaacgcaacgatgcaactacagcacaacccaaattattacgatctactcgtacacgcgccatacgacatccatttctatccaagccgatgtcacatagtaattctacctatccgatatttcacgaggggtgacaagcaaatcctcatatccggctatcagaacgaaggtttcttcgaaacccaggtgatgctgtgggctcctggaacaccgttgcatattacgctgcgttcattctctccaaatctgatcctgccccaaagcacacctatcgcaaccctgttttatgtagaaagaatgacaagccagaacactgaacaaaaagacgtaatcgcaaagctgtctgagaatggacattttattggcaacctgaagctccccagagaaaattttttacatcacgacgcgatcactgacttgtctttggcagctatacccaaggactcagcgactcccggcccagggacggtttcttcatcagtttccccgtcttgacgtatcctcagaaccatcttttcaattacatcgtctttttcttcaggtgtctcaaccttcattaattgcgtgggaataagagtttcatcctgaccgactttgaaatctgaggtttctctctcacctgccttcactttttgaagagcgagatctatttcccgttctccgttacccgggagcttcacgtccagcgcatccttaaatgacacagaatctaaatcgcgagacagatcagcatttggcagcctaaacggggactgcacagaatcgagatcgttttgcaacttaaaatttttaaacagattttgaggatcactaacttcaagaattctttctacgttagcttcctccgattcgcgtcccaacttgttttctgtaggcaacttaagctcggtcccagactgattgtgcaaaatgtcttgaatgcccttctcgcctaaactaatcagatttgtaaattcggctagaatcttgttaactcgctgcccaagacccgcttgaacatactgttcctctccggcatttctagcagcttccattaaattaggtaatggctcttgctcgttttgcgtcatttctttatcgacattaaactttcctgaggtttcctttttttctgcattgccgccagaatacaagtccctgctatttcctttcccccctcttgatacgtcacgagcatatttcttatttaacccggcaaaaatatcattcgcgtgcttagtttttctcaacactggggaatcccgagcagtcacagtttcagtcgcatcgccagagtctccggtcacttcgcgtgagtgtactatagccttatcatttttttccttagtccagcttccaagcagatctaacttcttctgtttcctaaaaccgtctttgtccctcaaatctttaatgagagaaacgttatggggcgacactccggtctcagtactgtgcgtcgtaagtttcgcctctgatccagccacatcggaattattcaacacgaagggtgtccctgtctgctcagaaaccaaacgatgcaccggatcgaaaacatctgcattcgccgctgtgtttttactccacggccgtgaaacatccgatttattctgacgcagattgagattagcgagaccatttaccacatcagtaataccgctactgggacttctgatcgaagttttatcctgtagtaaatccacgtctcccgtattagattgcgcctcagctggaagtttaacaccaaaatctaaaatccccgaagggccaattctataattaccgtgcgacttatctcgcagatccagattggtagaagtcaaagacgacaacggctcaactccggacattaaagagacagacgaaacaggcgttgtcgctctaacgtctctacccccgagtgtttctttctttatcaaaatttttcccccggcattatcgacgctatccgactctggaaatttatgtcgcctctgcgtttttaagggcgcgtccaaacttttgggttgacttattttcagacgagccaaatccgcagatggtctctttgtatctatagatatactaggtaaactcaaatctgaaggcatgcggccgtctaaagaggcgaaatccattaaagagtgaggcccattctcaggcaccgaaaatgctttcgacgcgctgtatgattccagactacttttgataatctcataatcactggtgattattttcaaaaaactctctactctctgaccagttagaggggtctgcaaaaccctctgagaatacacagcattaaaattctcgttcttcctcaaatgacccgagagatgattttgcgtggttacaatttgagacatagcaaccttttctagctttgaccaggactggtttaacgttacaaataacttaccaagataaactaatttattaatactcgtcactaagtaaccgttttcgtcccaggggtcatttatgttatagacggtgtaccagagcatgtttttttcagcgtcttgcaaattattttctatctcgctgctgtcttctgcagtaagatttacataaggagtatcgatcggaacattgctaccccacctaatagaatttcctaaacgcagtaaagcgcgatgaatatcactgaattgcgattcaaacttttctttgttcgtgaacatattttcaaaatttcctttattcagacctttggattttaagtactcgtttacgacattctggagtttcgtgatgtcttgccatatagcattataatccggcttccgtttagataacacgtagtgatacataagccataaaataaatgtgttatacagtgtttttaactcgtctacatcttctccctctctcacgacacaagaattagtcacatagggatgttctcgtaaatctacattctccagattttccaaattgctaagaaaatttgtaagacgctgaactttgtctcgatctagccacgcaaacgggatcgactgcgctttcaaatccatcttttagaaaacaaactcaaaaacaaaactgctcgtcttcgccaagactcaatgtttaatagtcctttttttacccacacagaaagctgacaagcgacgagatggacactgtcattgagctgtccaaactcctggtaagtctccagagatcattgttaccgaatattttattgtagcgtaccatgacaataacattcaatatctttaatagcacgatgaagagttcaaagacaacgcttcctgtacctcgacccccacgctaaagacagcacgaatcattgagagcgcagttaccggaatcacgctcactgcatccgtacccatgatcattatagtgattaccaccatgattctctatcacagagtcgcaaaacataacgctacttcattttacgtcatcacactctttgctagcgattttgtgctcatgtggtgtgtcttttttatgacagtgaacagagagcagctgttctcatttaaccgtttcttctgccagttagtttacttcatctatcatgcagtctgttcatatagcataagcatgctagctataatcgcaacaattaggtacaaaactttgcaccggcgtaagcagaccgaaagtaaaacatatagcacggggcgaaacataggaattctcctactagcttcctcaatgtgcgcgattcccaccgctctctttgtgcagattaacggagcaaaaaaaacgacgggaaaatgcgtcgtttatctatcctctccgaaagcttacgaactgtttctagcggtgaaaattgttttcagcttcatttggggagtcctcccaaccatggtgttcagcttcttctactttatcttttgcaaagctttgcacggcgtcaccaagaaaaaacacaaaaagactctattttttattagtatccttctcctgtcatttttactcatacagatcccctatatagctatccttatatctgaaatcgcatttctctacatgccacagaacacctgcttttggttagcccgtgcagagatattgcagttaatcattcgattaatgccacaggtacattgtttctctaatccgttagtctacgcattcactggaggcgaactaagaaaccgatttaccacctgtttccaatgtccattttttcccaaaagactatgtagtacacagaatcgcaaacagtcagacgtctccgaacatgatcagaactcgccatcagaatcgtcagtggatgaaaacgaacccccttaaacacgttttccaacttaataaatgctacccacataaaatcacgtgctagctctgttttctttgttttgtcttccatagagcatggcgcacgctaaaaagcgggcacgacgaaaacttttaacttcgacggacgatcccatattgtccagcacttttaccatgcgcccgacaagtaagattgcagacgctgaaatcatttcaagagaacatgattatatcgcaagcaaaacacaggcggattcaaaaaaaaaattatcgtccctgtctgtgatttttgacaaaactgtcctgtttgaattttacggtataggagacaacaacgaaaaagctatcgtctaccctatcgatccagatttcttattatgtgattcggaaaataattgcaccctatcacctttcttataaaatttttttctcctgatctcacgtcacagttttttttttcatatgtctcgcgttgatacatcccgtatgaaatatttaaggtggttgaaatcacaccaatgatcacacacgcgatggaagggtcgaagacattcaacattcccactttcgtcttagacgaaaattgtaacttcatacccgatgttctctcacgcgccaacgctaaatttatcaaagaggtactcatccgagactcctacaatgcggtttgtcttgcaaacagctttattcccatggcgactcaaaccgtagagcaaattctgattattatcacaaagtttaagttctcacgttcacgagatctgctcatgtcagtatttcgcctcggcgtacatataaacagattttatgccggaaaaaatcaagtcaaacatatgatcacaatgatgaaaagtcttttcgataccgaagaagccatgcgacaactcgacagagctcttatggggctgtttgtcgatgctcgtgataattcatatatgcctctcatagcattgtccctgcacgaaaacggcttaccggattctaaattcataaaagccgtcagattaatacaaacaaccgtaaactcctttcataatcgaccggacgcagatatcgaacagtatgcagaaaaattacgagcatacaattacctctataaaatacccaagtatactctgaaagaagctgtcgacatttattccgataatcttaaagatctcactattggagttaataaaaagcccaccttactgtttacgtcttcagatgacgcatatttatctcacatttacaacgacttactatttttaacttctacttggaatatgatttataattgcaaaaaagagataaggcgtttgaatacttggatcaaatacgaaatcaactccataatggaaactgctgtattggtaggattccaacttccagatctgaaggaaacaattctagacctagcggcactcatatcaaatatgaatctcgtcagccccgataaagaacttttccctcactacaaactcatattagcaaaattgtttgaaatctgtatttttgcaactaaggcaaacatttgcattttaccatccttcataaagggtcacctaatagagttcgaggatgtcttaaaaagaagcaatgatgacgaagacctcaactatctgcttctgaaatctcgagattctgatgacgaatacgatgaagacaaacccccaatacaagtcgatccaggcagagtagacaacgtgcttacagattctgacttttttaacgtaaccccggaaaatgctttctcttctatagcgatcatgccaatttcttatgataagacgatagatgtggaagacaatgaaattcaagtcctagaggttgagatgcagagcctctcagcagttgtctacggagccgttgcaagcaaatacggcttaagcctggagcaagttatcagaaagttaaatcaaaatgaaggacggacctcttctcgtgcatcccccagccacagtacttctaccgtcccatactcccccccgcaaaggcatcgctccactccaacttctattctaagacaaagagtaccaatacgttccaacagcagatcatcatcggtttctttctcacaggaagacagcaatcgtagtcattactctgacgaaacaaatattagtgattattcatatcccatggcagatctagaattagaagacgaagaacccatggaggaccatccgcactcccctcaatcaacatcatctaacaactccatgtctcgtcaaagccgagctctacaaaacggacaaagaagacgtgctcccacaatggtcccatcatctcagacacgaagacaaaataatgcccgccccagacgcgtagccaggcgcctaacggaaatgatgaacgacgcaaggttataatcacaaataattttattgactgtgaaaagtgctttatctggccaattcattgtacgataataaaagttccattgtttgattgatttccgtattcttgagcttgtagataatttccaatagaacatcccgcgttagatgtaactcatcaacgtaagaaaaaaaacgaatagcattctgttcttcatcatcaccaagtctaaggtgactcttctctaaaaactaaaaaaaaaacacaccatcaattttattcaaccaatctaagatagttttgcattaaacaataaattactgccagaaaaactatagcctagcaagctagtgaatcaaatacctaattccaatttaatatatcttgaaatctaccataacacgtacaaaatcaaactcaccgcatatatcatattaaggaaaagctgtttctcttgtctactggttaacatgtacaacaacacaattatcttcctgtaaaagaaaaacacatcaatcggcatacagtagcttgtcattctctcttcctgtaacaaaataaacaatttatacaatccaattaaagtcccttgtctttgtatcgaaagaaaactattaaagcccgcttccacgtatacttaaatcaatacccacctttttacaggaatattggtgaactgagctacgacgaaacagtcgtttactttccggatgttcaatctaaaaaattgattaatctcttcccatctttttaaaataaataacatttcaataactacggatttagtaaccgtcatactcaacgtcagagccggcaaaataaatctatacatagtagaaaagtccattttaaatagatatttaacgtatataatttcggtatttgacaagatattcgacagtgacattaatacaggcaaaggacacagttcacggcattcttgaagccgttgacgcttccacacatccatcctcgtcacagccaaagctctgttccgctcagctcggcagctctccgtattataaaaacagatactgaatcacacgctttaagaattaagaatcattggctgcttgcccatccgttaggacatctcattcttaacacatatccaatacaatggtaaaaaaacaggattaaaaaacaaacaacgacaaatcttatcatcagctgaaatttttattctgtatactaacatccaacatctccatacatcaagttaaatacaactcaaagtatgacgtatctatctactcttcatcctcagatgataaatcataaatgtaatcattcgagaatgtgggccctagaaaagtatgaggacacaacggcagaatttcttggacggtgctaatgttctgatggaaaaacttatagcgacgatatcccctaacaatcccctgtcttaaaaaagattcaaattcgtctgctattttaacacatgatccaattcctgttccgatcgtatcaataccataaattgcccccgataaatccatcatcacaaacatcgtcttcggatacagtaatgtttttccaatgctcccaataacatgcccgtgatacggcatgctctcgtagacatccgaaaagaaattccattccatcctactaggaaaatcttctttcctagtaagaaataaaacaaaaactccgtcgttattttccaaacaagacttcataatgtaatgcctcccactatttttataaacgatcgtagcaaatttccataaattatcctgcacatcaatcaacgattgaagaacatcatcaatttttgttaaaaagcgaatgtccttttctcgatataccggatcataacgacgcaatccgagaactgcaaatcgttccgtcgtttccgccaacaaatacagtgtctcattcacgaagtcgagaccatagaatcgttcgtcttctcccacaaacaccaacgttttagttaggcacacatcacgagtctcctttccccaggcagaaacatatccaagtagttgcaatctctctgggcagcaaagcaataacgaaccttgtttaaaaggaaaaataactttattttcacaacaaaaaacgagaaagacacattacaaaactgacacgaaacactgatacttacacatttcttgcaactctgcggcagactttgtgggaaatggaattttacacagtgtcgaaatcaccaagcaccgacttttcggccaattaaactgtatagttaagccggtcttctgttcaacgtatgtcgataaagaatcacgaaaaactgcaatttttatatcgtttaaattcattagtgcaatgtcataacgagttttaacatagtcgccgattcgttcgtctgccatctctacgttatgaaaccgtcaactacccctttggacccaaaactacaaataaaccagctcgcatttcttatccatcttttatagcacacagagataaaaaactcaacttaatcaactaccatccaaaaacaaggaacgtcatagtgttggactaaaattaccatttcgttcgcccatagaaaatcaacagagactaccggacaattccctacgttaataatatccatccttgtgtatgtaaaataatacaatgtaaacaataatgattcaacaatgaccttggtttcttctcatacaactgatttcccgtaaaggaaacgaatgataaaaaatcacagtcgcggaaaattcaaatactcgtcatatgagaaattccctaaaatcttatatataagaaagccacaaaccctcacaacctcatagacaccaaactttctgaagagcaaaaagagtagcaaatcacggccaccattacaactatgttcgccttcaacatcaacattttcttcatctattctaccggaagaaacaatccagagattatctctcaagataaacagatccataagcggcagccatcgaatgatactgacattgaagtggtaagaaatatcaaaaaacgcggatacaaatttttaccgatagaaacgcgatatttatttaagcactgttcaatcctttccacaggcagacttcttacccgaaaactacagtagtcgaatccgtaattcccaccgacaaaacaaaacggtaaacacttttatcgttttgttatacactaatacccaggagagctcagattttgactgatctgcacattacgaataccccagaatatttacacctgtttgcgatttttttataggtctcactgctccacattctaacgacactgggaatgaacgttatccgtgcttctctatcaaatacgcattgacgcagatgagtaagttttttcactaatccattttaaatccgacagaaaaacacaccattgactatatgtaattaatatttttttatttccgcagatatgatttaatccgacgaccactacatgttttactgtccacgatcaccttttccttaatgcaaatagcactcacggcactttatagaaaatgtctcacgatagtgcacaccaattttctgaatgttttcatgtaatttaataaacatttatttgtatcctaaatctttcacaacatgtttccgcgtaatcattgataaacagcatagcaataacagcatcgtaaatgcacccccagccaaaaagaacaacccagcagccgacattgaatgcgtaatttcagacacattctcgtaatcccttgaaaaatccaacaacgcttcaatctccttgtatttataccaattagtccatgcagacttccatgtatttcttaagaattttttcggcatcgtatcatttttaattaatgaaaaatatttcgaatgcacaacctttttcttgtaaatttcatccgacaattgaggacagatcatgctcaggaaatagctatccagagacactctctcatttaaaatgttcaaagtgccattggcatctggcccgtcacttgtccattgactcgcattcatttcagtgctggacttgagaacaatccgttccgttccataaaatagagtcatcacacctcctgcgctatgaccttctagccagcaatttacagtactcgatagctgagcggcatttggaagccttttagcgatcaaagctctgagcatcactcctctaaaataataattaataatcacacgtagaaaagccgttttttcagagatagatgtgatatttccaactttcatggctttaaagccatctgttagcatcgcaaggttgatcagatatgaagttctgacagaaacacagctggaattcccagctaacactccattcacataacaagtagagatgcatatagctccaagtttctgttcctgaattaaaactattttttgctcgcatgtgagattcgatgtaaagcagactcccattacaaaggtataaactaacaaggactccatagttaacttcttcatgatatttagaattcacagatcgtttgcaatttcttccaaaaaatctgccgcatctctgtggaatacaatagaaacaaatttgaaactttataaaagaacaaacccatttaagacgcggcaacacaattcagtcatctataatccacatcactttcgtgcactcttgtaccagcacttgccacatgcatcaagtaaaaacatccaccatccctaaaactaccctttgcgcgcacgctctccccatccgtgaaataattaaaaaacctacctcagcacagctgccgattcatgaacagcattttctgggctcttaagccaatgaatgttcggtttgcattccgatggagtagcaatgatacaataaccttttaaaggtttttcttgcgccaaagacgcaccaccctgaacatgtttacaacctacatcatcggttgccatagcaccgaccactgttgtatcgtacaccgagtcgattcgaggatcagagacatcaaaggtattttttgcggtcgcttggacttccgtttccaaaattgactgatgaaccaaatttccaccgagaaacagagtttctgaagaattatccaccacgtcttcagtttgagtggcagcgtcacacatcgcctcagaccgatctgtctgtgtatgcctcgataacataatttttataccaggagttttggtaagtccatagattgtgcaatggcgagcggagttgtcttcttgacacgataaagccatacacaccgtccccccaacatcttttttcgcagatggctgcaacaattcttccgtcggccaacaaaatggacccttagcaccgaaagagtcagactgaattggtctcatggaagcacgagcatcttcttccacgcaagcaccactctctaccttctgaaaccgtctaggtaatacacctgtcaaagaaattggggtatgtctcattctcgtaaaatatttttgaaattgatcactgtattcatcgcgggacttctgtgcaataaaattactcaagatcgcgttctgacacgagaactccatggcagttgtccagaaatctgaaaacgtaggtgacaaataaaatatcacaccatcttcatatccaagcacttgaccagttgacgataacaaaaaaacaacttgtctctccggagccgcagatgcaccttcccattcctccgttacaccaaacatactcatcctaccctcaaaaggatacaacccgtttattaataaacatctcaactgacggtcagatagaatatcggaattgtcacagatccgaactttgatacaagtgatatgttgaagaacaattccggaagccatagcttcctgtacaactttctcaaatctcagagcggaccccgccgaagaaatcatcttatccttaaactgcaacatgcgcgccagttcatcaccggtgaatgccattacgatgttttttctcgttaatgattaagataatcggccatccaaatatgtaagaactgcacaatcttagttaaatttatacgaaaaaatactgcaactccggaaatgggtgtggcataatctctaaaagcaccttaagaaaaaaaacagacactgttaacaaaaaaaaccaatttatttaaaaaatctctgttcaaatcacctcacagtcatggaaacattttacaaaggcaacatttctaacttgacattgctaaaactttcgtgagattttattgactgtcgttctatatcaaacgaattatttccgcagacaactgctattgaatcatcacggacgttttgaacgctatgaagttccatgtcgtgattttcagcttcgtagttgcagtattctacttccataatcaccataggcacttcatcattccctctacgcctttttagcaccctatttggattcgatgaagatcccccagaaacaaaaaactgaatataccgcgttaaaatatatagaaacatacacccagcagcaattggaattacaatgaaaatccacaacagctgcaatttattaaatttttttctgtgcggcgctggaaaattatgacgaggaaacgtgtcctcggattccttcacgggattcacaaaacctttgaaactaaaagcatcctctcttgttaagagagctggggtaactaataatttatgcgtaatttcacatgaaaactcatgatgtgtcatgctcaaagctctactcaatgctctttcataagagtatagaagttgaccggaaatttcggttctaatgaaatcgtcagtcgtatgatcatctgaaactgtttgattgtgaagactccattgaatgttcgttccaatgggccgatatcgtcgagctgtacagacgagcaaacctgtatctctcttgctgaaaacttgcggaggacgatatttagagtctccgaaaacaaccttaccatagaaatttaagatgtcttctacacaaaaacgtcttgcataaaacgacaatacgtgcaaagaacgattttgtaaaaaactgctcacatttataagatcgtgaacaaaactacgattctcattaaacagatctatctgtacataggttgtatttctcgctaaaaaaacgtagctgccagacaactgcgtattattgttgacgaagcaaaccaattcgcttacagaaaaattttgaactgagacatactgaagcccagcgtgcaatctatgaaattcacgtattaccacatgtcctaaaaaacggtctacggtagaattttttccttcttccaggcttcccgcgaggtcaaacaacgtctctccaacagccgtatggttccgcaaagtcaaatctccataaagcctctcgtaagcaaaaacgatatcgttatcaatgccgataacggtctgaagtttaccgattccttcagccagagtagtcttgatgtaaagtttagccggcaacgaagaaacgcattgaaataaacatgcgacaaaaacagttatcatttttaaatctttaattcacgtcgaagaaaggtacggcccttgaagaaacagttaaccgccgtagtcaataacttattacaaaaaggccacatggaattaacactaacaaatataaagtatattatctccttcagtcctacaaaacaggaaatacccagaatacccacacaaaccgccaccgcacccatgaacataaggttcaccatgatagatgttatctctgcgaatgctaacatagtcgaaccttcgttataaatctgaatagacttttcgacattcttctccggaagcgtaacgataacattatcgccactctccttattcgtgcacatgcagaaatatttatcccctacccacttatccaatgaaataagtccccacgtcacatcatcgcgaaacaaagacgtatatgcaccggacgatctcatctttaccgttttccataccatatcaaacgtcagcggctcctccgcaaagatctcgatctttcccagcttgctaacaccccaacctgaatattcacaaactgcaaattctccttctgcgcccagccacctagagaacgaacatttcaaatcatcagctctgaacaatctttctgaagaagatctaataaccggcataaaatttagttttaactcctcgtcgtaagacagagccattcgtctaaattcgccgtacaactcagataggactttaacgtcgttattgcacgaagatatcaagtactgtcgatatgtcgagagttcagtccaaagacgtaacatcgttctgtcttcaccctggaaattcttatctgcaatccaagagttattgctaccatcgaggaaaaaagcaacacgtagtacttgtttcttgagatttgtttcattcattctactgagtcgtatcgattttttattaacagagcattggacttgaatgctaataaatgtcatttttccatgaccacatttttgaacacgctttcttgcaagatgcatggttgcactactcacggtattaaacaatagtttatgtacgttatgaaaaacctggaaacatcgaaaaaccaaaaactttccaaagtcgtattcaatttgactgtcttccattcctccgtaaaacacttggttgtttaccgccgcactaccccataactccattttaccgcttctccaatttctgtatgcagatatctctaagagcatctccccagatctaaccgcttcaccgttccctgcgccaagggccggacaagtggaaggatagatttcaccccggacgaacgttaagacgcataagaaaacaaagcagatcatcatgctgcgttttccttctcttttgcgatcactagcgcccactaactccagcgatgcaatctttaatataagatcgccgtcataccacagcgtcgaggggttacgcccacatattaaacaaaggatccaaagcaaaccagcaagaacaaaaaaccacaacagcaaaaaggtaaaccgagatgcagtaataaacaaagcgctcatagcggggtaaaaagcgtcttctttcttttcggcagaatgctacagaaatgaagcaatcacctctctctgtagttttcctagcgtaatccactacatacgttttagttctaattgactccatcaccgattgatttagtaattgtaactgcacaccgctcggaaaggaaacattacacgtagtatcattgtccacaaacacaacaccaatatttttattgtatcgacataatatcttagaccccatggcagtctcgataacgcatcgagggttaaataaaaaggctatatctctttcgaaataagcattaataggcacactagccatccgccaccaagcagttccacttctctgagccatttttacaaaaatcaaccaatgtcttaactccgtttcactatgtgttccgataaaaactgaattttcattgttaataatatgcaaagacgctatcaccgacacgtataatacactcacccatgctaaactccaaccctgaggcaccataatcactagtaacaatctatgggagcctcatctgcaagtctttgcatccctcctgatttgcacatccggtttattctcttcatcccaaagcaaagacctctgcttgtctttcttataccaattatacaaaataactatcacaattatgaatgccccgacaaaactaatcccgcaaatccaaattactaacgagcttagaaaatctttaaaatactcttcatctccctcatttgtatctgttaactcagggacttgaacagtatcagtttcccaaagagcatgaaccgtcttttttggtgtggatttcgtcggcaaaccctgaggcgtcttttcagacacatcggaaagtgtcgacgctaagattactgtgaaaaacgtctcaatatcctgcgcctcatcacccttgaccgttggaaacgaacttgttgtaacatttacattattgccactggatcgatttgtggttcccacggctagcgtagaggtcaccatagaagactggtttaaatatgccacagaagctattgatatttcggtaacatttttaccccacgtttcgggattcgccgaaaacgtagtttcagatttcccagttaaatagtcgctggatgtcgatacattcgtttccatatttttagacgcaattgaggcaaattcagttgccgaaacttctgtagtcgttaggttgagcatttgcacctcttcacagagacacacgagtaaaaaagacaagaacaacatgtttttgcgattacccaagtgcaacggttttttaatcacacccacaccaagatagcagaatgaaaacaatcttttagaacaatgttccgcattagtttttataatacaactcgacgaattcaaattaaaaacacaaatgccgatcataagaaaacacgattttgcattaaattcagacttcctcatacattcagatttgtcatgttagtttaatagtcgatgcctgctattccttttaaacaatagagatttttcaacgttcatgtttccgttccacatcgggtcagcaaatgcttctaagacaggtaattcatttttttcgacgattcacattgaaaacgtaaataacaaaagcaataaacaaaatcattgcgatacgcaagcccgtcaaaactaaaaaagcaaacgtctttcgtctcttgttccacaaattccacgctgagcgagatgactgcggaggcggtaagcattcaacaaacgatgtatcattgctagcgtgcggagaaacctgtccgtacatgacgtccatcatcagcacctctgaataggacggcggcggcgtccgagggcgatccatcctcttcccgacgaagattcacgttgaaatacacggcgaggacaaaatttctccaaacggacttaaattactaagataatcggagtagacgagaaatgcgagcacaaatgcgactacgagagtgtatgttccttcccagagttcctcggcacttctaggaatggggaatagagttttgcttataagcaacatggtaaaacaatacaacctaccctctttcaatacaattaattcccctgactagagacgtacatatctttaataatcctcgatcccggcgcgacctctgacagtgctcacggagaggacagaggacgtctctagaaaacatctcatccacctgcttaatatagtccgtatcttgcgtaaaccattgcgtatgcaaccgacgattctcattataacgcagacatccaatttttaaaaaatctgacatattgcgagctataaagagaaggctctcctcgcggtcgacgcaaaaaagcataccgtggccgtcaaacactactacgagctccctccagtcaccgaaaaaattatgctgtacaataaacactacatctagtagactcgtctgcagtttcctccgccactgaatcaaatgtttactagaaaacccagtcatgctcagattgcaaaagcgaacaaaggtcttgtacggatacgttttcaaggtaaaaaaagcattctttctttcatttcggtaatgtaagagctcagaaaacgatttactgtgagcaatcatatccagtgccacagtactgtccagtgcataatcacacgtctcataaatcggataaaaaaaccgcaaaccattagaaaacaaatcgtgaaaagaagaagccacgtgataaagacttctgtcaaaaaaaccattatacacatagatgtgtccccgcgccccctgaaggacaatcggtcccctgcaggttctggtttttgccttatgtataaccccgaccacaaccaattcgccttcgcaacacatataggtcttcgcccagttttgaacatcttcacgtgaaatatccggaatgttttctacactatgtagagtcaaccgataatcctcgggccagggcaaagctaaagtggcgccctggcgattttcgataaaatttaccaacaaatcgatgtctttgcttgaagacaaacccataacgatgaactgcccggctcagagcaaataaacacaaatttgaaaaacattaatactgcaaaaaattttattggtgtccaccaaaacaagcacgataaattgtctaatcacacaccaaaatacatgcaacacacgactaaacaaaaaaagccgttcaataaatcacccgcataaaaagatctgtctttcagatcgctgctcaaagtcaacataatcgaactaaacccgagacctaaaaaggcttcaaagataattcgatataggcagacgttcatcatcagtcccgacaagatcgccaccattgcgcacgcagcagctttgaaaacatttagtttaaaaaacacgttgttgaccaccgtcagaaaaaaaagatgattagattttggcatactcaagaagatttttccgatccagagtatcgtaaataataacaaaaattcgaccgtaaactttacaaggtatttcaaatcaacttcacgaaacgacgttgacttcaaaatcggacgatatttttgcaaactaataagaaatccagatgatcgtatcatccatccatatctcagagtaaacggcaggagaaacgcagtcgtcgtcaagacagaataatcatcgaacatttgactcttaaaaaataaagacaccatcatccccgtaaacacagcgggggaataagacggcataatcaggacacaacgacttaaaatcattctcaacctcatctcggaaaaaatcaagcagatcatgaccactgcagacaagaatgatggcagtttcgccgccattaaagacagaaacacaatcttgaaatcacctatgggtttataaaagcgtggatcaaattttttaaaagtcaacaaaaaggaaatcgcaacggttatcacaacgcctatctgttcgagggaggacctcccctctgtcattctaaacggatacagccctggaataacggcacccttagcaagaccgagaataaaactatctgtcagacgacgcatctctgtctcttaggattggagctgtattcaaaatgcatggaatcgtcgctctcgctatcttctttctcattaaataagctagagcccgcagtcccgtttttagtgggaaccatgtagttggttattttatattgcgtttcctgttttgatgccaacgcacttccgtcttcgttcttatgattcctatccccttttccgtcatcttgtttacccattcgttcaaagcgagattcctctttaagctgctcctgagttaaaaatgcttccaccgtcaacaacgtgcttttggaagttaagatcaatttacagtctttagcggctaccgtacgtaaactacacgacgtcttgattacagcacacatacttaaagcctgctgtaaatttttggcagataaattaaatcgcatgttcttaacatcgtaaaatataaccttattgctgtttgaaaactccagttcattcatctctgtcacgaattttatagtcggggggttaacctgtactataatgtgcgccatgaaagtgtcagatttaccagagcgtttagttttagttacgggcgaaagccattttaacacctcggaaacggtcgaatgatcaaggtcaatcctcaacggcgatttcccgctgtctcgcaccacttcttgtccatgcacacagggaaccgacgcctgtgtacatgtatcggaagccgtcaccaaaaccctcgtatacaaatcactatcatgctgaatgtacatcttcgtaacctcaggattcgagatgatgttcataaaactttcaaagagtggaatatgattattaatggttttcgttaaaaagtgctccgtatctgataaaaacaaacattccgcctgaatggtcagcttttgcacgagatgatttttagcagactgaattattatcgaaggctgcggagtgaaagtcactgtagtattctcttttaacagttttgtaaacgctttaagcggtttattaatagttttccagcttttcatatgaaaagctagggtcggcggttctctcagttctctatgttcccgatgatcacggtgatcacgatgatgatctcgactaccgcgctccatctctgtcaagaacgaagtcctagcaccaactcgcgccttctgtgctttaaaaaacaaatgaaatgaccaacacattatatactgtatttttttggcgccaacattttattacatcattataaaatgttctttacgtgcataaccacaccatccgagcatttcccgatcaacggtaacggatttgataaatcaaggtgtttatacatctcagaactacacaaaaccttatacatagcgactttgaatccagttttatacagcaacggtagcaagtgtttcaaactcacagtatcgttgaaataaaatacatttgcctgcccctgatccaaaaaaggcaacccactcttatacatctcaatcaaatcattcaaaggataactaaaaccatctttgaaaacagctaaatcatccaactccttgtccgtaaatagattcgtgtccacgtttaaaaccctatatcccacagtcttcaaatattgctgatgcttattaaatctgttgagcaacagattgttatacacgggaatatataacgattttaattctgacgaataaaccgaagtgacatcatttaaaccgtcttttccaattacgactttgatgtttgaccgcctgagaattttattgtcttccatcggccagaacgattcagaagagttgatgatatcgaattctttctgcatggcagtaccggcagtgaaatgaatattgcgaactccgtgcatcagcacatctttccttagcgttgtccacaattcctccggaagcgtgcattcgacattatcgaattgatcaaagtataacatccccagtgcgtattttgacctgtcaaataaattgcatggctctgctcctttcatgcaacaatccacactcgttcgaacacaagtataataaatgtgttcacacatcattcgatataatcgacaagcatctggatgtgcataggataacccgacggtcatgaaaacggaatgaagacccgtaatacagatacctagacttcgtccatctacaattccctcacgcagaaaatctttattctctacagcataatcaattacagcattagcgaccaacaccatttttcgaaccacccgccttaattcattaaacataaaaaatttacactgcaaacgcacaaaatcaatctcctcggttagctcatcgcttacttcgtcacccaagaaatgcaccacattaagcaacattctcaaacaagtgttaataccgtctctgacaggtaaaacatccaaaaaatcacccccgcaatacaaaggcacatgaggaatcatagaatactgatatacgttttttcggaaaataagtcccattctgcccctttttaaacaacggcaaattttttccacaaaactagccatagtaatttttgcatgatctgttgtccgctcaaactccaaatattttgtcgagaaagtaacttcgtcacactttcccagttcaaaagctatatttttatgaaaaagagaccactgcgctctttttagctcgtacctatccatgaaaatcccaggaatgatcaagcaaaatgtgacccgagaagtctcaggtagaacttgatacaagtccagccacgttagtgcggacacatgccagacttccacatagactgtcaactgaaccgtcttatcagtatcacgttccaccacctgaatttgagacagtaatatctcaaaaatattcttggcttcctgttgataacgagtcacattcatgcttatatttgaaccgtttaacaaagccggaaaaagatgctcgccgtttactgttataaaatccgcaagcgaatataaacatgtattgtaaatcgccacgtcgaaaaccgtactattagccttttccacgaggcccaaatttgtcatacaagaaaacggtaaaacccatttttgagtaaaaagggaaaacgccaattcttcgaatatcacgtaaggattctcctgatatatctcccgcagataaccatttcttaacacgatctctgtcaaagtagcacacatacgaagatagatgcatggaatactctcttcgacaccgtttaaagaattggaaatctcctctaaaaagcgagatgcacccaaaactcccggcatatattggtttttccaactcacacttactttatagaggacgctacgaataaaatctcgatacttctttacaaagttcaatacatttggcataatcacattagggcatgataaaattaaatcgtccggacaaaagtcgtaaaaaatactcgtctttagataccatcttcctagcattcgatccactcgtggaacgcaatgtgtagctctcaaaacagagattatggcatcccgcaaacaccaagcatctaaacctgagtcgagccgatccattatcttagcgatgtcacgaacccgttcatacaaaacagaagcgcatgaatattgagaataacaaaaacgtttttgcgacgcttcgtaatgacaaacgcattttctgttgtagccaaaatctttattaatacgacgctcctttctcttcatcttcagacagaaggctcagaagctatacgaacacttttttctcagaaaggtcaacgaatatgttctctagctttatcaccggcagggtaattccacgatactgcagaaaacccgatttaatgtcctccgttgcgcaacgaccaatgcgctgaacgcttccaaagtaactcagcgtggtattgctattaatgagatagttcaaaaacagaaaccgctccttttcgaaatactgtcgcaagatatcaactaccaggtcctcgttctgaaaactggtcagaactacgtagatcccatactggagctttgataaaacctctttgtaaacatgaaccacgtaaacgtactgggtggaatgctgccgcggttcccagtctggctctaggaaaatctcttttaataccgtaagcccgtgaatgttttctttgttagcgtcatagacatttccttgcatgacgcatgacaacagacaactgctgccgcaagaaactaagctcgtcacaccaaacaaagacactttgtcttccaggtacttacacgtgttgatcatcgataacacgttatcaaccattgagtttgtatacatggtagttaaagcggttctcacgcaagcagacacattgaaagcgttcgaacaaaggaaaaacagacccacaaacagaattttagggttgtccacatcagtctcaaaacgatacatcaacattcccaaattttcgagctccggagccaataattcgcaaggcgtgaaaacccttgccgctatacgtaaattctccctgccggacaaaaactgtttcagaaatttcctttctttttctacaacattatttaaggttcccgcctcgatagatatatattttctcttcttcacagcttccacagtatccacaatggcagctcgtgcactcgatttagagttcattcttagttcactcaaaaacagcacgtccccagaatcattactagccgctacggcaaaaatcgagattttatccctggcagccgatagcgtaacacacaacagagtaatagcttttattaatcgactgcccccgaaaaaatatcactttgaccttatcagggaatatacagttttctactttttaaactctacgaccttaacatcagaaaataaattgctctccgcagaacttttacacgaagaactcagtcaaattcgctcttcgagttcgccgggcacagaacttgaaaacttaaataatgcagaggtcctttacgtgttcgatcgaatactcaattccattaaaatgctaaaaaatgagttatcgtctccaatcggcaaacttcgagtacaacccgccgccaacgacccaggtaccgataaaacgataaaatactccaagattcaatccatcatacaaaaggtacacagctttacacgagaaaattcacttcttgccaactgccgcgccgtcgtagaactgatagacgatctatatcggaaactttactcatggtttctacatattctcactttcgaggacattcagtttccaggcgacacatttctagacaggctgttgaaaatggactactgttttacatattacccttcttcaaatcgccatctaatagatcttttcgaaaagacgttggacaatcaaacatccacagacatcgataaattttttgacacttcaggaaacagtccagaactactttatcaaaaaacgtttagcttgaaaatattttcaaaaaatctcacagcccaggacaatggattatatatctatccactacttaaaaccgacctgtccatcctcgacttcctcggaaccgaaaatattctcttccatcgaggtctcatctatcacatacttcatcaaaaaacaatccctcaagaacgggagaatgatctcaataaaatcaatcaatttttcgctactgtcatccagcaggttatcgaaacgagaagctcatgcttacccgcgtcgttatcccgactcttagatacgatttttcacttcaacagaatcggtttaaacatagaaacgtgcagaatctacgtcgagatcctctcaaaccacatggcgacaccagacacccaacccataatcaatacattcaccatcaacttaatccatattgttttcaccgcgcacgtgtttttcatctgcatggaaaatttcagcccgacattcttattctataataggaaaaaactcatattagaacaacagagagccattttgatcatcgaacgaaatgaatattccacactctggaaacaaatatctgatcacatcgactgtctcttcaacatctctctctccgaatccttttttaaagaatataccaaaggaggaaacgaagaacataaacagtttctatacaaaaacctattcgaaaaatggggtgacgtctttttccctttcacgtactcggtaaccacctcaaaaaactccacggcacaccatattacaacccttgagctaagggccatctgcaaagaggtctatcagagcgattccccggaggcatacgaatcgttacttccctacagcactcatccagcttttaaaacattattcattaaaatctacgttatacctatggtcacatacattaccaatcttacctttgataaattacaatctgattacagactcataactctgatccacgcctgtaaactcttactcccctcgcaacatctactactacactacatggtgtggctatacgctttttccataaacgtagaccacatagatctaggcactttcaccgtaataaagtccgtaatcttgaaaatcgctgaccacataaacgtgatgaagcatacgatctactcccctgagacaaaccttctcgtaagcattctactaaaggcgtataccgactaccttaaaaaatacgtaaacccctggatcaaacagaccataacggcaaacttctccctgttacagacgtacataaccttcacgaaacaatgcgccagcatcttagcgaccaaatgcaacataaacttagacaatctatttatctccatgactatcggaacagaaaaaattgataccacttcgttttactccttcatcgctacatgcagaaatttagtacgtcaacacgaagaattcaaaaaatcactaaaaacgatcgaaacttccaaaaccgcactcacgaatatgctactaaacataataacaagcgtctcctcctccaaggagctgctgaccaacgaagcactacaaaaattcatcgacactgtccaacgcatctcccaacacgtaaacgaaacataccagttaatttccgtgaacctcgaaaaatgtaaaatctcaaacgacatcctaatcgaatccctaaagaagaccatctccatagttgatgtactcagctccgatgcaatcctaaacacgtcgttaacttctagatgtctggaggccgccacgctcgcggtttcaaacaattctttcacaatactcgaaattaaaaaggacgcagttgccgttttcaagccttttataacacaactatttgaaagcatgaaacccaccacgagtctatataagaaattgatggctacccaaaaattgaccaccgaccgcattccatttctcgatatcttcgacgataggtacaacctagtcagacacgtcgaacgacaattaaactggtacgccgcatatgccgaagcagcgcagcaagatcttattgcttctcttacgttttaacggtcgcgttctaacccatgaaaatcattaccagtagcacgaaccaaaatgactctaaatacggaccgagagccggaaaacaatgcatgtcgaacagcttttcatttctccacactgtttacttaaacggaattaacaattctctcaatgcgggtactatagacgccataatggaagaaggctatcacttagacacggccagcaccttagctctaatgctagataactcagattcgcaagactacagactcctcaccgaaatccccagaaggatccattctaggtacggcgtcacacagcatgaactctcacggccatttaacggaaccctagacacacagaaaattgacaatgaggtatattttggcctcatagatttcatactgtatggcaaaaccaagaattgtccagcttttgcagtcatcacgatcggcgtcgtatcgcgagcaattttttttcttaacaatactctctacttattcgactctcacccgactgaacgagaagccacagcagccatctacatctgtcaagacattgaagaagcttatgaactgctcaccgcccacggcactgaaggcttctactacgacgccagcttcatttttttcatagaaacctccaatttgtcgctctctagtcacgacgccgagcttcttatcctaaaaacttataaagaccccgacatagcgattacgctagataaattttcttccacggaaatccatgatataaaaaaaacagatgatatcgaatcgcaacaagacctcgttgcggctaaaacgacagatctagaacgcgcgccccagaaaagaaagaaaaactctcatagtctagaactagaactaaatgacaagaagaaaaaagataccgcatccttgacatattacgcaacggaagtcgacctaattccgagcttttatgaactacgatcacaatttcaatctttatttcacgatctcaaatcttttcctataatgaaatctcaattcaactggaccatatacttacaagattctcccatgaatcctaatcagcccttcgcaacaccctttctctggaacagagtttttcacttattgtgtcaaatcgtcgacgtgtttgtaggcgtcggatccacaaatgacgattctagcaaacaaaagcagcaaacgattttcataaattatttattgcctttcaaggacttttccgaagtattcaacgaggcgttgacagcttgtcaagaaaacaatctggacatcctcttgatttacaataattacctgtgcaaaaccacgacctttcgaacactcgagagaatcttactaagcaaatttctggcaatagctgataatgagcacgaaaaacattatgaatgggtcaaatcgtggaccacacaaatgctccaagagatgccaaagaaactagatgacatagagaattatctaaaagcctatgtgagccagaaccctgtgaaacacttccatgaattcgtttgtctgaataaggcagaaaaacacaacatagctgttctgctcaacgaaaaacgaaaagagattcaagaagatattgaacgagacaagaatattttcgcacaaatctctaattttattgacaaactcggcgaaactcccgcacttcctatcgaatcagaaaacgtgcacaaagttcacacgagcgacatcactgaagccatcgttccgcgtttcatgactgaatcgattgaattaccaaacatctccacactgaacaacacccaacaattatccctagaaaaacaaatcagtgaaaaactcaccaacaccatccacacactcagaaacaaattcacaaaaatcgtacaagataactataacaatctcgctgccggtttcatgccagttaccgaactgaattgcctatttgcctacctggtaaacctttattttaacattgaagttttaaaacacagcggcctaaacattaacactgagttgcttcaagaagtggaaaaactgtatgacaacacgcaatttctacgcttcggaacttctcacttcaatataaacaacctttcgaactttaccctatctatcagaaaaatgttcgtcgatttctataacagtcaaaaaccctcggacagagcttccgaaatcctagccgcaatcgaatccatcttagcggaccccagcaaaaacaagacaatcgtaaatatagaaatgatcaaatcacaactggaagaactggggaaaatggaaatctccaccaccgaaaacaagcaaacagctgaaatcacaaaacaaatccttggggaccaagagttaacccctatttacgatttcctgcaccatctctctgcttataacctacctaatactacgaccgtaaaaaatttacacctccatttcatcttagaaaaacgaccagatatcgctgcgattctccacgataaaatacaatccatacttgacatatgtatagacgacatgctcaatgacataacagtccctgagcagacgttttcaaccgttctatttcttgtagatctcttcccaaacagcaccgaaaaaacagcactgttcgaatccgttctcacactacggcaattagcaaagaaatgcgctaacttaaaaactctagaagaattcgacgatctggcccagttcatcacgacgaacagcgaacaactccaaaacatgatgaaacagcattttggaaaaaaaataccaacgctgatggatcatatcaaatttctctactctcaaaaaataatcaccgctgaagagaaaaattggatacagagagcaaaaacagccgtcattacatctcccgaagaactgacagccttcttagccactgcacccactaaacacgccttacaaacttgcaagcctgagctcgataaagcactacaacgacatatggaagagcaaatgaaacaaactgctgaaaacgacaaaaaacacatccttacaatcagaaacaccctcgaaaaaagactgaacgacatcttactcattctaaaaaacggtcaattctcgtctttggaaacagtgcatttgaatcttttagaaacctttctaaaacaactgcaggataacgatctcatcattcacttcactcatgcactactgccagtgttaaaggacatagaaacgaccatcagcaagaccatctccgacattctcgaaaagatattaatcaaaactcctctaaaccccgaacagatgtccaaggaagaacaaaaatatacccctttactcagtttcttatccaagttcaaaaaaacaacattctgcacagaagatgtaaaaacagagatcgaccaaatgcaaaaaagtatcacgttcctcacgaaaattgctacctccactaataaatatactagaatcagccactccgtctacggacaagaattaaacctctacgaagaacgcatcacagagctgaaaaaagagacgaacaaaataaaagaaccgctctccaaagaatacgcagtagctgagaaaaaaattcttctctcgtcacaagatgcaaaaaccaataaaatttatctagtcctaaatacgcacacgctgaaagaaataaaaaacacccaattcagagaaacggcatctgctaaagctctcacggtcgaagtcaacaacaaagaaaatcaactccaggagctgttaaaccactttaacgcacacctaaaggcgaaaatggatcagaaccatataacaaaactttcattcgatacaaaatggacagcctttgtttcggattccaggctctacttcccagacttcgttgacatcaaactgcaggactttatttctgatccctttaaagttataagtcagctgatgaacaaagcagccaacgagatgccttacattcaagcagagataactctcaaatggttaacacaattagtacacgacatcaacaaattctgcctgtcagctataagcgaattcgggaaagaagcaatcccgttcaattacgcggccctacgagatttggagtaccagattaacaccaagtacgtagaaattgaaaacaaagtcatctgcaacgaaaccgtcgagaacacgaaaaacattccgaaactgactaagctcttgaaggagttagatcctaaacgcgttgccggtggccagaaacagtatcaaactctcatgaacaagattctcacttccgaaacttctatgcaacagacctacgaaaaagaacaactcaaaaaagaatacttcgagaccgtcaataatgtcgccagcttcaagttagcattcaactttcctaagcaacgacaaaatgtggaacgactaatggagaagttcaagtcgctgcccaaaagccagccatttgaaaaatttccagaggaaaatgacctattttctgactcactcatcacagaaaattatattaacggtctgcgcgcactcctcaacttcataacgcgtgcgcaaaactacatccagaacacacttctgaaacaatgggcggtatttcagcaacaaaatttcatcccgatcgatgactcagtagcgaatgtcaagcctatttcggatttatatgcccgcctcaggattgaacgggaccgtcaagtgttctaccaagtaaactctgtctttggaactcaactaattgttgacgaaacaggagttccgctgcaattccacaacatcttttacaacgccgtagtgaagtttttctccctgaactacaagcagattcatgtaccagaagacaccccccgcctggtatctagccaatataaactcctgtccgtgtgtaaatctttcataattatactacagcagttctgggagaatataatcactctggacctaggctccgacctcagagacggtacacaaaattttaaaagagaacttataccgaacgtgaacttgaaattatttatatacatcataacacaagcctggacagcatctgaagacagtactgtttccacagcgttcgaattgcccatcaagcaattcacacttttgatactatgctcacatcctgaatatctctacggctgtctcagtcatccaacagatctggttataaattcattagccaaaagcatagacaaagacagtctctatgacacattcgtcgttagccacaaccctcccgagaagcccatgcatttgatgagaagtatatgtatcgacacccagctatggcaatccgccaaacttatgaaagataccttccaacaaacattttttacacaactgtgcccccaaaacgaaaagttttttatctatctcactgccttcttaattctcccctataaatttctgaactatatttggattcaatacaaaccgatcacttttacccaaagatcttatcaaaacttaattaaggacctatgctccgaatacgtacaccaaaataagatcaccatgtcctcggtaactccccacgaaccggacacaataaaatccggagaaaagattacctcaaaaatcaccgtacacaaagcacaaaacacaccgacactcactcgcctgcaggctcaggaatatgtcttcgactacattctttactctttcttgacggggtacgaaatgacattcgctatgtacatcgacaccatcgaaaaaacatacctgctttgcatgagacacctggaaaacgtactccacgataaagacttccaatccgtcctcagagcacgcacattcgacatcaactacatcctgaaacagtcatggactaagaacatagtcgaacattcaatcttttcagtacagctcaataaaatcgtctcctacctcaaccacacaaacagagcgacacccaatattcccctgatactatttaattatgacaacgaagttgtcaacgtttatctaccgccgatgtccaccaatccaaaaaaagtcgctttctacataaaaaatcctttccactttcccgtgcaagaatacgaagcgacagatttaatttcctttcatctctacccaaaaacaacagatattttaaaccaacttccgcccaataaaactgtgtctactcgcccatacaaccttagctctgaaactttaaccaccaaaaacctctccgaaccaaagtttaaacagcctaccgttactggacttatgcccaagagccaatcaatcatcctatccactgataccaacgtactggaaaccagtccagacataaaagctaacacggccagcgcagcgataaaagatgtcactctagctcgagaacaaatcagcgagttctccgaatcgataaatacaactctttcaaaattaaaatctttgtatctgtaacattcgacacacaaagtcatgctccttttataaatttttattagttaaacatacgaaataaatgaagctttcatcaatcactccctgtttttgtgttcagtctatgcagcgccagcattcttatcaaatcgagtcggaacgccgttttatccacgttaccgccgttctgcttagcgtattttggcaaaaagaccccaaggacgggatgattggccatggtaggctgcagccctaaaacaccggtaagcatctgctgcttcttcttttcctcctctttttttgaagaacttcctgaaatctgagtgatctgattcgacaaatcatcaccacgtatggtcgtcatttcaaatacacctcacgttttgggaaatctgacaaccttgacagatattaacacagtcttccagatctaagcaagtctctctaaacgaatgctgacaatgctgacactgaaaatcagaaccgtgtgaaacaagccgtaacaacttcttgacggtcacgttgtagagatgcacagtagaataacaggatctacacgaacaaggaacaataacatcgaacttcacattgtcatttaaaatagtgcaagcagaatttgttccgatcaccgccttccatgaaacagttttcaccttcatccccaatacacaatgctcagacatttcatatatccgctcgaacaccaactgctgactcccacacagcgaacaatacattacatccgtatgcatgctgtatatcaaatttttctcctgcttgtctctaaaatagaacatggagctcaacgaaaagccctgcggcgaacacaacttttcttttccggagtttaaacagtgaccacattttgcacaaataacgcaaatgtaactctcttcaagtataaaccgagaacatttagtcttacaatagcacatgacgggtaacgaaataacactggtagctaagccatcctttaaggacgttgccagggcaaaggttagaatctttggaaaatcaccccgttcaggtttgctcggcaccataggtactagattattatgctccactggaataagatatctgtctgcgctaaaacagaagttttccaccaaagccttcgccatagtaaacatgaaattccccgccggagatttcaaagcatacttttgcaacatggagggaaatgacaaaacgtgctctctctgcctatatcgcaacatcaccgtctcggtctgctcatagtcacgtaaacagaatagcctcatacacggtaagttgacgtgcgtcggaatcggaagcaacaactgttgctcgaacagaaacatgtgcaactcattgatttcggaaaacgagggcatctccagcaacttattaagcttgtacgagggataaaccctaaatctagtctcgacgtccatccatttgattcttttaagtttataaagagacaacaattcgagaactttgcactgccgatacacgaaatacagataggcgagcaaaacaaaaagaccctttgtcataaccattttgttaaaaagtcgcttagtgataaatcgcgtctccggcctgcaacgcagccaaattgcaaaaaactcattataaaatttttccgttacttccttattcaggaattttttatttgtcaagaacattgtaagaacacattttcctggcacacaggcgtcacccatcacaaacaattgcaaatgagtgtacggcccatgtttacacaaccgggccagaagctggcgtaggagtttttttaagtagaacataacaaaaatacaaggctaaaagaaagcagatgctgacaatcgcaacccgacaatgcctttcacttagtctcgaaaacttcacaccggacaggaatgacttttctttttcatagaactggtttatactctcctgtgatgtcacaaccgcagaagctttatttgcaatttctccgctacttccgagttgccccttttccaaaacatgtgaagaccttcttcgcaaaccttgacaaaacctattcgattcgagatgctgtttccccatagaacacttctttaagaaaattgccttcaaaagcgaaatgtattcagattcgttttcaggcccaaacgccacaaactccacaacgtaagtttcgtctcgattacgcctaattatacatttcgtgaacactgcaaaagttgaaggcttcatagccactatgtcgctcatgcgaacagtcaaacattcattaacacgcagaatgttgcattctctcacagcatgatggccttctgctttaaccggggcatgcaaataacaagacatcgacacacgtccgcctgtgtttttgaacacaaatctcggttcctgcttagttacatgttcccagagactcaacagatattctagattataagcgtagtctaacttgagaataatatcacacaaaggaaatttcggatttttcgacaataaattccgctcagtcatcctatagtcatgagaccccaactttaagatacgacaggtcgcactcagtagttcatcgtacatcttttctttgagtacgttagccatttcacctatttaaaagctattccgtatttaaatattcttgatgttctaatattccatttacatttaacagctttgacaatatcgaagtgagaagtatgattttctgagccatgacctctcgatgcacgcaatcgacatccccgtgaacgtatctagaaaaagcaacgtgtctatatccaacactaagaaaattcagtcgcgcctccaaagaaggaagcatcatttcatataatcgtggcagcattggataaaacacgacctcaaactcccttccctgctcacagacttgctcatacaaaagttcaagattcgtcttttcaggtgaggagtccatcatgtacaaaggatgggactcagaagcgttgtctatacaatctgagatagtaaacgagattctgttatattgctacctcactccccaaccaccaattccttccgaaacgacaacagccaccagccccacgaacatagaaaacgaaatctccaatttagaaagctctgaaaacctagaggaattaaagcgattatccgtcgcattaaatatagacagacgatgcaatatctgctccatcgtaaatctgtgcctcaaacaaaacaaatcatggatctacgactacagtctactgtgctacaaatgcaactacgcgccaaagactccattgtctcttctgatcgtctccgcggaatttataatgttaatacgagaacgatttccaaacatcaattttgacggcctttttcagaacaacattgtctccatctttgacttccacgttcatttttttattcacagatgcttcgcaaatacggtcaacgatcacatccaaagcgaaaacataaccctgatcacatgcatatcgatcgaccctactaaaagagacagtataccgcacatcaaaataaaaaaatttctaaccaaaaaaatgaacccgaaaaaaacacaaaaccccgaactgaataaaaaactcacagtgcccatgaagactcgcttcacgacactcttattctatatgtggtctggcacaaacgtcttcgaccgagttcccttcacggacctaactatccgcaaacatcgcttcatcaaaaacctgtattccaacaaaaccgacatcgaactcacagctggtcccattctattggcacagattccattttccatcaccaaaaacaaaacaaccagcgtctgtctgctatgtgaactgatggcagcttccaaacaagattacctatttttaaaatatctacatcaaagcatcatggactactgtcaaaacaacctaaagatgatagatagagttcagttcgtcattgccgatatcttcgagaagacaaaaatacacatgcacgtcaagaatctttccgactacagcaaggcgatattcgataacgaattctcattctccgatgataacttcactctcgatacccacgtttacctgatactccgccagactggaacagtgggagtctataagcacttcttctgtgatcctctgtgtctggcaaactgtaaaaccattaacccggaggttctcttcaacactacagacgccggagaaatccaagacttgaaagtcaccatatgctaccgtaacgaatatttaagcatcgtcgaaaaacatgtttggctagcgatacatcttttcaaagcttttcagattattaaaccaaaccataaaaataaaactcaaattgcagagtttctcaaagacttcactaacttattagcgcttcaccacttcgatatcgtcgatcccattttcaccgtcaactactacgtttaaagaatgactgtacacaaaaaccgttttcgacgatcgcgaagcctgtccgtgacacacagaatacaaaaacgacctgatcacagagaaaaaacaaagctttacttacaactgaaactccacgatctacacgccgtcttcaacctgtttccagaatacgaacagaaatttctagcgatcataaaactgccaattaccggtaaagaacccatcgacgtcccattcagtctcagcaatcaccatcaacacacctgcctagaattctctccctacgctaacgaacaaatctccaaaagcgcctgcctacactgcgaatccgtctccgttccaacctcctcagatgcaatggtcgcccacttgaaccaagtcaccaacgtcatgcaaaacagattttacttctacggctttcgaaaggacatggagctgatacgcatgtccgccaaacaacccactatctttcaaatcttttatattgtccacaacacgatcaacaacatattccctatcatgttcgaaaaaaaacaaaagctcggaatgcacatagttttccagtctcgcactctgcacattccttgtgaatgcattaaacaaataatagcggtatcttcgggctacaacgtttatctagatatactacaagacagtgtaatcctaactgtcctctgcgaaacactagatactaatactaatattcacattgacatagggatgcttcaaaaaaagctcgaagaaatggacatcccaaacgaaatcagcgatagactcgaaaaatacaaaggacatctaataggtttccattaaaccactttattgttaacatgtacaaacgacaaaaccgaaatacgttcacattacctctgcaatagcagaaaacgtttcatccaaatacactttcataggaagtaaatacaatagtaacttctctttttttatatcggtcttcggaaaaatgggtgaaatcgcattagtcacagccttgataatctgatcgaaatacttctccgcatgtataggaatcttgtgttctaacacatagtttggatcttctgctaattcatagttatgcgtctgtttattaccagtagatggtgctattaacacatacataattcggtcaccaacattcggaatttcttcctttctctgcgccaaccttctaatgacgctaaggtgagccagattcggctgcttatatgcagccacctccttggaaagcacagaagacaacatcaaatgtctcacgtctgcccgattttgaaaaagctcctcccgcgctttgcacagacgacgcaaaattttatgaatacccacaggcactccttcgtcacgcaactgtgtttgcgtcatgtgagaaaactccacagcagcagtctgaacctcttcatcaaagaacaacaagtccacgatgtctttcaccacacctttcacaaaatcgcaagaagtctttctcaccagatctacccccttaaaaattaaaagcgagtcatcctgtctaccaatatatctttttttacaaatcaaaatgagcggacataaaatcttctcgaactcgagcttgataggcgatttgaacaagcgatctgtgatatgtttggcgatcatcggcgcaatcctccgcagagactcattagccatatttctgacagacataaagatgctatccgtatcaccatagattacctccacttttaaatcaccagtaaaatctgatgccgttagacccagttcttcgcaaaagaattgctcggactgcatcttggaattaacataatccaccgtggaacaaagcatctctcttccaagacaggttacagaagcagcaatcgcaacacacggcaataacccgtgcgccgctcccgtgacaccgtacaccgagttacatgttgttttgagagcgagctgctttttatccagaaggagtttcatcattggatccgaacagttttgcatctccgccttcacttctcgtctcttggccagccagtcctttagtagacttccaagcacagactcgcgaacacaaggcttcacaaaccgatgggtctcatcccccaacttcacggttaagatgtcactctctgataatccagctatttgccgttcatccaaaactaaggtactataacacagattatgcgccatcataatgctcggatacaaactctgaaaatcaaacaccacagtgggcacagcataataacccgtcttaggctccaagacggtagcccctttgtaacctatcccttgtctattatgcgaagacaccatactcggaagaatcatgttacgacgttttgcttccgtaagaatgcagggaaatatcttcttctgctgaccctcgaacaccacacatctagccgtgacgtgtgccaatctggcgacctcggcaacctcataatgataattaatctgtttaaagagacgcacaactaagacagagtcctgcagacaatatttaccgacaacagccctgccactgggtccgctaataaatttctttggtatttccttgtacgataactgctctttttcttgctggagacagatcttagcaatagtatccagtttgtaattctgcgccgttatcttactagaatagactggatacatatccagatataacactccggaagtaaacaccttggtttgcgcctgaaggaaccccttcttgtactgttcatgtggaacagagattccaatctttccattcttcagtttagaaaaacaaccaatctcatagtggtaaatcttatccatccttatacacaaatattttaaatcaaaattgttaatattataaccggtaataaactccggagattcaatccttaaaaatatgaaaaatcccaaaagtaattcaaactctgacgcaaattcatatatatgcacgccgtcaatttgttcacaggttcccagagtaaacagatgtctctcatcacggtcgccctcagtatcgaaactaactacagaaatctgaataactatatcacccaaattttcggcatccgggaaattcccattttggcccaaacactctatgtcgaaggaccagcatccatataagggccaattgacgttttccaaagaaactaaatccgagacatgacagttaatttccacctcaagattactcccttttcccatatcttgaggaatatatttttttacattataccatccgaaactcaaaaaaccattatcgacgaagaaacgagtcaaaacatctacatcgatttcataaactacgaatccctcattctgcagaatcttcccaatacgttgagatacataaaaatttccaaaactcactttaaacagattaacaacagtgttggcattgtacccatacaatgacaacttatcagccggctcaatgacaaaagaacacgacatcttaacctcgccggttaacatcaaattgtttatagtagccttcaggctttttccgtcgacacattcgcagtaaaaatattgctcctgtccaaacacgttcacacaaatcttctcaccgtcctcagatctcccaaacatcctaatcactgtccccgaaggaatcacaaaatgtctatactgaaaaggaagattctcgatcgaatccgtaaacattaacgtttctacagcatcatagatgtggaacttcatcctcgtatgatcataatccttggaccgaactctgtccaaactcggccaagtcatttctttgctcagtaaatactgtcggtctcgataaaacatacgcggttcagagtcacaaacatcctttattaagcccgcagcaccatcatgcattataccgcgaggaagtatacgaatgtaactcgatctgctttttttctttaagcgattcgcttccaaatatggattaaaaaatgacaccgaatccatcacgcttcttctacatttacactcttataacctctatacctgatcctgtctatcaaactaggttttgaggcatgagactcagaagacgaaggttttcttctgtaggactcgtctaaagactttatggccttgagcatttttaaagcatcttcttgtgaatattcatcaccacttatttgtccactgacgtcagccataccctcctctttttccgaaaccgcaacagatgtgcccccgtcagcatctttaacactaggcgtcttgacggcagtggtccccgtaacactggacacagtagtcaccggattggtggcataaggaaacatcatgtcaataggcttactaagcacatgtttttgtctaacgaaaaccacaattattataacaacaactactatcgctaaaatcaacatgagaccacccccgaatggattttttaaaaaagacaccactccacccacaatatccccaagtgctcctgccgtaacacttataaccgagcccaatccagtgcctatagccccaagcccttgtaaaaaagaattaatcccattgacatacgacggcgtattagtagcaattttagcttctatagtatatagtgcgctcttatatgagttatattcacgaagaatattctctaaatcgaaaacgtttgctctactcaattcgtccggcgaatataaatcaagtagtttaaaatcagcattttcgagagggtcaatctttagtctaataaaagcatccaatacctcaatgtcttctatgggcgtcgaattcgtatgcgtataatcggtatacacgtgtgcatgatttccagatagaaatatctttgtactaggtatctcacattcctctgtcctatgatcacccaacagaatctcattatctaaccctagctgaccagggacaacctcaggcgtggagttcacaaagctaaacgtcaccaagggccgattataacacaccgtttcactccttaatcccttcgcatcgacgacccgcatactcttatgaagctgaacggatgactgattaacttctatgcatttcgagatagctaacacatcaccatgcaactgtgcagatatcggacgaccgtaaacctcagacacgatactcgatggactgatcttactaagttcgtgcaacatcgttatcgttcgtttttgatcgaggcaccaagattctgccaaattccccaaggcatcgttgatataatctttcaaagtatcatagaggtactgtaattgcacataaagaatatcatgtctagacttgacatccaccaaatctcgcctcctacgtaagtttactgaaccctgctcaagaaccataagagatttttgcacaagaggctgccaaatcaaaatcagatctcccgtagtcttaaaaatttgataactaccgttcatgctgtatgtatcattataatctgacatatagacttctttaattatattctcaaattcattcttaatacacgtttgtttggggtcggtaagatttaaagaatccttgggggtgacgaaagcggctgtcaactccttagaaataaagtgataagtctcatccgtctccgctcgaagcccgtgagtcaccgtagtccaatgctttagcatacacaccgattcattctcttccttgatttcccaagaaaacagagtatcccctttctcgagaaaagcgatcttccttactaacgtagtagccccattcataccattcattagatcttctatcatagtatagttttccaagattgtcaatttttctaacggctctgcaaaatgtttaccgtttgaaccgtcgaagaacggagacccttccacgatttcaccagtcgtcaaagcaaagtaactaaacggatatttcgccttagccgtagcctccgtcacaatacaattgagagacgtcgatgtagaatagagccacaaaggaccccttgcaaagtagggttctttcgtagtgataaatcttttattagtaacagacttgaaattcagaggaaataattctagagtttcgtttttattattatcctcatgataggcactaaacaccgtaccatcgggtcgttttatcgctacggctgaataacactgcgcacgagaattaactaaatttgcttcgtacatcggcatagccaaacccatcaccgtccgatccagaaaataaaccacacccacatcacggtaactggtttggaacgtcagctcgtttttatacgttctcactggaaaagtgtaggtctcgatatttgttttgtaaatgatgaaaaaaccctccgacatctttgcattagacttatatggcgagcacgaaatatctctgtcgaaccgcatcaaatccgtacctttggcaatcgaacaaatccgaaaaggatatttgtgattatagcccgctctgatataattatccgaatcgcaatatatcattaaaacactattcatcaaaaagacagccaggaataatactgtcatcttgctcattctccctaacgagatctagtagattaggcgttcgaacagagtaacttactccttccggcacgtctatagtctccctcgacaactgagcttgcaaatcacaatataacagcgaatacacgtctttaaactttgtcatgccaccaccggtgtgaaataatagaggagactcgtgattaaatgtcaaaacgacatttccattcaaatcctcctcctcatctatacgtacaatttttaatcgctttccgaaaacatcattatatagtgcaacagaaagtgttaactctctgatgaaattccacatttttttctgcatgtcatttacatcagttacaccggaaaagttaaaaaactcattatattcgcacaccatccacaccctgggatgaatagtgccctctatgcatttcgctaaatcttccttcatatgcggtaacatttctgcgtggtcgcaaccatacgccattgagatattcgccggaagtggataggcagatttatgaaaatccgataacggacccgttaacaatgtgtacataatctcacttaaatccggcaaaagctccaaagggagcttcttcggcatcagattatttttaatataaagatgttcatcgtatgtacagctatctacacgaagagagccatccaagtacatttttctgagaacgaaaccgttcataatcttcgataaagcctcaaaaataaaattcccatacacgttcacactcactaccttattgatgagtgattcctgctctcgaatacatgccatcaccctattataaccagattcagaaaccttttgaaaatacgcctttttccgagccaagacttcctgctgaagattatgagtttgaagcatgcaattgatcgtgttcagccttcccggtgtttctgtcgtctgtggatcccgaatgtcatgcaacagactcttaattttatgttgaacctcatcttcctcagccaatcttttaaatattggactttcctcgagatttttaatgctcagaccagtgacaagatctatcaacctcgaaggagacacataaatagagccaacgtacaagcgctcgtcatgcgtgagcaaattttcactcaaagccaagaagtcttcagagacttcaccgtaaagataaagactaacatcattctgtaattgcttatacaacgtatgacaactatttaactgctgaagcgtaatagcaacatttcttactatcgtttctgatattttagaccaatacgtaaactcacttaaagaatatatcacgtcaggtaccttgctaaaaatattatactttttcagagttttctcagcatcactaacatgcaacgattcggctgaacgctgctgcttaaaaatcttcttgatttcagtcacaacagactgaatagtcccatagttcaaaatggcctctcctaagtctttttctatcgtctcaatatttttttcaatattaaaaaaagctttttgctcggtcaaatgattacagaactttccatgtaatcttttccgaagtgattttccttggtttggagtcaaagtcaattcttcataacacttcatgcaagtcttggtttcgagataactctccggtttcgcaaccatacatgcgccacacatgatagttagcaagtctataatttttccgcaaatctgcaacccttcttggggcagaagtaaagcatatacggagttgatcttactgattaattgttctatatcatttagcgtagataattgcacgataaactcaacaccgttatttaatgaaatgtttattgacaagtgctcagcacaacgtttcaaacacaacaccttttcaaaatatttttttctatcctggtctaccataaagctttccaacgctgcatccaaaagaagcacctgttcatacatagcttttagcagcacctgcatataaaccgtcaaagctgacgcacaaagaagattctgttctttgataccttcaaaaaaagtttgatataaatgcagaatgacaatcccattctttttgaaatttgccatatcagacaatactattacaggatcacaaaactttaaacattcaaggtccaaagcacattcattaagcctagcgcacaacacacacagagattgtaacgaattcatactctgattataatcggtttttcttagtcatcggctcatccgtttcggtttccgtttcatcacattttaatacaccgcttgcttgatcgtcctcctccgctagaatttcagaaaagtcatagaccggagcatcgtttgaagacaccgcctcaaataccgactgcaaattagctattgaaaaatctctcacattcatatcaactaagtgattcagtttaagcattatggatgccgctaaagcttccctaccatccacaaaaaaaagcatatcatccatagtcggcttgtcctccctatccctcatcacctcagctattattaataattctggatcaatatcgttagttaaattctcaacaatgctgagaaccttgcccttgaccacttccgtatcaaacataattgtctcacgccgaacctttttcactataacttctgagaactttgtagcaataatcgttttctgcctcataaatctaaaatcttgcaatgcagaagaggtagggtttaagttcctatccacgccacttccacctatccaacctaactggccaaactgaaaatattccctattagccaagctcacaaatttctctaatgtcaaaccaaatgtaaccaaagatcgacttgtaaaaattgtaccaaaattgggttctttggacagtgacgcaatcacaggattcggaacgccatccaaaactaactttttaacataaactaaatattcctgaatagaagaaaatttaggctgcttgtctaacaccacaggaaacaacacaggattctgcgtaaccagcttagatgtaagaccatgtaagctagtcaagtagtcatgaaaacctaaagccgacaaaaacttgttatgaaagtaacaatctataaaagttgagagacactctggctgtatgtcgataatgtctatctcatcataggtattcgtaatactgaatgcaaatttgataaaagtcttaacttcttcggggttaccaatatctaaagttttcggaacattgttgagcagaaaacgttgccataactctaagcacgaaattttgacattcggaaacaatttatcatgatatttaaataaaagaaaggagatacagccagacaagggattcttcttgtgtttcacgttctttttaaaataaggattgttgtgtgctgtcttactggacttgttgaacggtctgttttttattctaaaatctcgaagacattgcatagacaaacggcaaagtttcgcctgaatcgtagttttcacatatttacccgatttatatagatcgcaatctaagatctgctccatatcaacattcgaagcgactttaaccgttctcgtattcagaaaaccctttttgagataactgctgtgaaacgttccgtacagtgattgatactgctgaacgagccatttagaaattgaattaccagtacaaggtctgtcgacaacatgacctgaagccactatcaatgcgaggttctgcaaaaccgttaaaatgaccttataatatgcaaacgtcaaaaaaggagaaaatgcagttgcataaggggtcgtatctacattaaatgattgtagacaattttctatctgttctctaggcgtttgtgtccttctcatttcaacaatgcatctagaaacacattcctcgatacattgtgtcaatccgtggattatagaaacaaaatcttttttacttcggacattgaaagtatcttcgcctgttacaggatcaatcaaagaattttttttacagtaatcgaagatctgagatacaaatttacccctgtccagtgagagcgtgttttgttgatcttttccaatctctttgagctcgctgacaggcttcctgccaaaagaacctaatatatcaacctcggcataataccgagaaaacatgctcataacaagtggttcctttttaacattttttggtattgccggcaaacgagtaccaacccgcaccatggcagttccaatacacgattgacaacatttcccatcacagaattcacataaattcgccgaacaatttaccagatgattgtaaatttcagtgtacgcattacccgcgttataaacgctcatacgatttaaattccacactacataagaaagcagctgtgggcaagtcgcacaggcataagccaagtgattagctgaaaatttgtcatctttgcctgatgtcgaatcacatttgatgatttttctattatcgttatacacatcctcagtcaaagacgacaacgcattacaaaaagacaaagatcgcagcagtaattcttgagtcatcaccgaattaaacgcttgtttcacgtttggtataaatgccaattttgagcaatataagatagaatttggcgcaaagatcaaaacggcaagatgactagacagatgtaactttaaattcgtgagctgcgccatgcgttcagcgtgtgtctctgagtttcttatgattggccagtcattgaaattcattatctgactggggtcatacaccgaatccaggtattcggctacatgactaaacgataattctgtcacaacggaatcaaccaacatcaaaaaatctttctcgaccgctgaaattttctgtccggagatacccagataagttttgtggggtgctaatttgacagtttgctccccatcctgtgtaaattgtttcaggccagcatcgattaattccttagtattagaaaatcgtaacgttgtaccccatgatgtaaaaacataataaaaaagcgtttcacttaacgcaggcagaaaaaatcctcgttcctgaataaattctgtacaggaagataaagaaatcgtttcttcagtttcaaataaagttgcagagtatagaggaattttcacacacgaatactccccaacttgtacttgaatttgttcttcaacacaaggaattaacagaccagcgaacaacaactctttgaaaccgtttccacacgcaacatggcaaataacagaatctgcatctttgccgacagcagaacaaagagctttgatatcgattactttgcgtgctgtaggcacctcaaacgactgcaagtgaaatttctgtctggtttgctcacataatcgaataagatcaccatgatcttcggccataccaactaactgctcagttccatggaaaaaaaaacacacgggcataaaagacgtaattttagttagaattgtgcctccaaagttagtgataggtgttttaaccgtggtcgagaaatcgttttctacagtcaaattcattaacaacggcgaaataactacaggagaatttctctccattaacgataaaacagataaaacatccaaaagttctttctcttttggaaaaacatagatccaagcagcagtagaaacaggagcagaaaccaccgtttcgttttcatcagccatctttgtggattcgatcacaaaaacaaagataatgggtttttgtggtgaaatccttatatattatgtttgacgtaacataacacgcgtcatcaaacataaaagtaaaccacaagttgaaatataccgttttctatatgagttttacggacaaaagaaaaacgattttcttatgcaaatattttccacgcagatgacatgacacgccccttaatttaaatttatgtaaatcgtcgtccacctcaggtacaatagtatattatatatatagttttttaataaacttattgaggacgggagaacgaaggcgtggcgtttacgtcatagcctaattatacattctcagaacaggatttaaaaaggctgcgagcggccggctgttcagagggacgctggggtacgacttgagacgtttgactgaaaatgatccttcgtgtactattttctacaaaaaaattaatttgccggcgacagtaaacttttcagcggaatttcaaaaattaattccacatgtaatttaagcattttaaaacgtataactcacaaggtgaaaacatatttacgaatacagtagttttcgtgatattttttaaaaattaataaattttaaatcgtgtaagtaataaagcatactattagattcttcacgttaacagagcaagctcttcgaggttttcagtagaatttcaatatttaattccacatgtaatttaagcattttaaaatgtagaattcacaaagtgacaaaacattcacaaatacagtagttttcacggtatttttgaaattaataaattttaaatcgggtaaatggtaaagcatgctgttaaattcacgttaaaagagcaagttcttcgaggtttgctatgtgtttatcagtgaatgtatttagtatttcaattttagatcatggttcggtaaagatataagtccgtgtaaaattttttggtttagttttcatatctactagactgtgaggtgtttgaagtcgatggtttagctcatgtcaaaacgcaatgtcaaattgtaataagtcgttcatttcgtgtttagaaataaggaattggtatttagaatagctttgtcgcatttttagccgcgacgagaaggttatgacgacgttttcgattgcattgtttgaacctttttcggagtttgaatttaccgtttaaagaaaaacagtttcacgaatagaatctaaaacaggcttccaaattttagttaatatttatttcgattttcacttggggtacagaaagctttggcatcgagatttttttgattttaaaaagaaatagttcagagtgtgacagcaaaaacctttgtacaaaacatacttgtaagaatttgtttacagtaagatagttattctgagtcagaagaatatgtgtttaagttagtttcacaggtgtcagcttcatagtctaaatctaagtccatttcaacacttgattcactttcatgtttagagttgacgttttcattaatgttaataatcacaatttcgtcttgttttgcttgattgaagtttagttctctaggatctggtattttgttgtcggtttccattgattcttctatgagaatttcggtagttgtttttgtcgttgttaggtttgaggtgtctggtttttcgacgcaaactttggatttaaccttaggcgtaccttggtttttatgtgaacgatgagaggtctgaggtaggtcgcgacttgttgaatagctgcatgaaggttccatgtcgacctttggacaagtaaaagaaagatttcggtattcgtgaggaagatttggaaacagcttaaactttggtgcgtctttggcgaaataagtgcagaaaaatagacttggtttccaaggagccatgattcgttcgattctattttgacagctgacatcatcgcatttatggttgctgaattgctttccgatgagcctgcttatcagaccgcattcgtatcgctcggctacacgttctgtgtcgaaatcgcggatgaattgcggtttctttgttcgtatgatatgttctttaatttgtcgtagtattcgagcgaacgtcacaacgatggacatggcttgttgaattgggtgtctaaatgagtctggagtttgttgttgtacttcaaattcggagtttggcatctctcgatctagtacaggtttaccgcagagttgcctgagttttcggtattcgatgtcgccgtgtccgttgtcgttgaaaacacaggttaatttcgccatgttgagtttgttgaaaaattcgaatttcatgacggtgatggtatacatgaataagtcttgtgggttgaccggtaggttgtgcagatcgtgaaatttaaaataactgcaggcttcttctactgtagcaactgtaaaagcaagacaaggtgagttggtcagggagaatatccggtcgcccattagttgctgattttcttctcgcgtgagcgagtcgagacattgtcgatagcgaagcagcaggtcggtttccagtatgtcattagttaggagacagattcgttcatgcgtctgtggaaatctgtctcggatgcgttgttttggatcacgggcgtctccgttgtaaggtctcaggccaagagattttatcgaaaagtttgtgtcggcaaaggggactgttggaaggttaggcagaaaggtgattgcattgttttgagcgcgtttttcttgttgtttctcttcgatgatggtcttcagctgttctaactctgtcagacttagtgcgtctagtctagattcatccagttgtttcagaggtgcgagttttcctcgaaaatttttggcgaaatggctgatgaacttgctggttggtctatgcgtgatggaacgttttatcgttctgaaggcggtttgtttatgacgatcatgttgtgagcgttttactccacgaggatacatgtttgcttataataaatgaaatgacataaattggcctctttatatgttttttgagatgctttccgttggcgcttttttgcggttaagttgtgtgaaagaacgaaggacggtgttgctaatgctttaatctccggaaatgctgtgatatggcgcgatttagttagcatgtgcgttggagtcaaatggtaaatactaaaagaaggtctgggtttataggtagtaagttagttttttaattgctctaaggcgatggaacaatgtacttgtttgctgttggactggcatttagtagcaaagcatgtgctccacaagatgagaattaaccgatttccgtcggctttgagttgtatgtaaactaggacgttatctcgatttcctctatgttgtctgttcaggcagctaaaatccgaaactcttccaaattgtgtttttttgatctgaaggttctttgaatctattttgagaaaagttacttgtgaaaactgttgcgctatcctagtctcgtaatgagtaattaattgcgttttaatgattggccatccgattaatctaataaacgataaaagggagtcatccgctgatgttgcattgttgttaaaaccatgcgtgttcaggtacttggtgattagagtgtctgtagctatgttaactttgttccacagttgtctggattttaaatccatgaaacttaggttttctttagggcagcctttatccgttatgctatagattaattcttcgatgggagccttcttagtaccgtgatgtagaaggttgtttaaatccatttgcatctgaataaacgtcttgcaagaatttcggtaaccttctgggacgataaatatgggagttagccgtccatgtagcattttccctttgtccatgtctgtcttgtacatatagcctattctgatgcagtgacctgtgtggtaaatgccgatgtcgaaacattctccgggaaatgttagggaattgaggatctgactaagctcttgatctaaacacataacgtgatttaaaatcttggataattgttttaatggttctcccccggcgatcgctgtgccattaggtaatgggattgatattctaagaccgatctttttccgacaaatacagaattgtttgatttcggttggatcttcagtatagtctagtgcgtcgttagtcgtgtcgcactgggttttgaagaagaagatgggatgtgtgtgtgtgtcgatgcttggaaaaatttttttccaggcgttgatgagggtaagtcttatgaggcgacacatcgagaaaaatgtttcctccgtaatggttgctgtatcttgcagcggaagatccaagtctcctatgtaatttgtgactggtatgcgttcgttgaatatttcgtgtcgtgtagtatagaattgtttttcgaagtcgtcgcagagaaaatgtgtgtcttgtagccagatggcgcgagttagagcttcatcagagatatattcgtcggggagatactgtaagatgcggttaaatcccatgttttcgtaccaatcttcagagttcccgaagcaaaaaatatttttatgtaaaagctgcactctgaatacaggaaagggacggtgataatctttgtgtaggtgttgtcttctgtagatgcgcttatcttgtatctgaacgtatttatcggaagcggagatttctaataatccttgtaatcctggttttactggagaaaaaagaccttctccgtttttattacatttcgctatggcacgcgttatttgttcggaagttaatgcttggatggtcttctttttagaggccagagcatactcgtattctgtaacgtttagatctggatttttcagtctttttatatcgatgtatgttttaaagtaacaatccgcattgaagtattgcttcatgatacacagtaaattttcgtgcagggaatttccaagaatgtggacatttctctggcattgttgtcctattggtaaattagagtcgtaagaagtgatattgcagtaattgacgaattttgtcgtctctagggccgtgttgtaagcgatatatatgtaatggacacggaatgtgttggttagatgtgaactctttctaaatagattgatttgagtgtctagatatttaaattcttccttatcgcggagatttttttgtctggcgtacgttgcgaagtctgcaaatagttttctaaattttgatttcaaagtaatgtttataaattcggacatggaagaatacgtgaacaccatgcttcctgtgttttccgtaaagcattgaacataatttttggtagttgtgatggtgctcttttgttcctcgaacaaatagtaatacatcgttaataaaagcagaccttctgtttgcccgtaggtcgatagaaaccaaaagggggaagtgggcaataggaatttaccggtgagatatttgataatgagcgatttgtggaaataggccatgtatttaaattcgacgtcctctttttcttttccagtttgagataatatcatgtcgacatataacaattcggtttctttgtcgttgaggctgttggcaacatcttcagcctttatcggacttgcagtttgtatgtagtggctgagatttaatttctcggcgtggcagacgaataccgtgtcgattcgctttgaatttttgcatttttgagtttgaaggcagaagctgacgttatttgatggtttatatttaacaataatcggaaagattaaatgttcactgggacttctacataggatactaaaaatgacgtttgcggcatcgtattcagtcgcaaacactacgatggtcattgtgtagagctctgttgattacagatgaatttggctttaaatgcccttagggtattggggtgttatgggaaattgttttcgacgattatctctgtttggacagccgactcaggcaaattatgagatgttgtgctcttccgacgatttagaaagtgaagagctgacgtattttctggatatgacgtataaagattttggagtttatcagaatgatattataagtcatcaaaaagacacggaaactatgaaaactctgttaggtttattaccaatgtacaaaaaaactaagctcaggcataccattatggagcgatgtttatccaattgtcctaaccacgttaaagatgcactctgtgtagagcttatgaaagctgaaaaaatattacaaacgatggatgtcgtttttatgaaaactttaattggcgagttttctatgtgcaccgataatcttaatcagttgcttaacaaattcgctacagatcagtcaacacttagcgatgtcgagaaaataaacagtctcatagagattgatggcgaaaacagcaagcgtcttttagtagagttggatccgattctccatgaggagacaggattatatcaagcgctgccaaatgttgtgacggaagctccgagtgaaaaggttaaatcgatacacgtcgagtctgaaggtgagagtgtatggtcaagcgttactgaaggcggcataatgaaacaagaaaaaggaactggcgtctagtacctgtagccggtttattgcgcgttcaggcattaaactgaggcagaaatgtccgcaagtaaaaattattctggcgatgcagatgcctgtagggatgtagatagttttgcgtgtagagttgaagatctttatggagggaattgtgtctttgttccagatgtaggtttcaatcaataagccgagtttgataatttctttggagggaatcatgagagcctttagttcatcggcgcaaacgtacatggcgtcgaagcattgtatcgtatagctgttcggtttaattataaattctctgcatgtctttagatggaaaactgcagattcggggggagacagattgatcatctcccatggttccgggatgtagcaagggagaaagttgattgagaattcgacatctcctgggagaagcattagggagtgctcggataagttcattagaaaaactgaaatgtcggtttcgtcggttataatttcagtgatgcattcgcagaatacgtcgttgctatggccaataatgactccgaagaaaccatccgggatgcacagggaaatatctagttttacgattcgaacttgatcgtgcggcacccatatgagttctctatttacgagtgtgattttgttggcgtccataaaaacgtccattttactattcctgtgatggcttactaagatagatggttcttccgaaatacaagtgtccgtatttgcatttctttttgcgcggtgtcttgggtagaaagttactgggttgccatgtttccttacatagttaacacaatcggtttctctttgcttttctcttttgcaggtcttcgacactgttccattttgcggaatacctagaagcgagattgggcgttgataagaggttagttcgttttctagaaattttttaaatgatttctcatttatagctggccacacatcgtgcgttttgtcttcagatatgtctgtagtccaaagttcattgatgtccacgtttcgaaagacgaaaaattcaatgtatcttgagctcgtttgtctctgtagggtaatcgtttcagagatcttttctgaaattacgctgtacatttttccaggtgacagagggctgtctgctgttaatcacgtcgacgcgaagactagttcaaaataacacttaagatgagttgtaagaaaggcgcaaggcaacgcttatatgtcagtctctggctcttttacattcttgtttttgcggccgctacggaaatggacttttattcttcagagtgccattcgcacacctatgagatcgtcttgaattcattttcttcgatctggcttttgataaatctttttttactcttgtgttcttttgcgattttcttgaagtactggtgttataagacttttgcttcagagacggtgaagggctattagatcgcatgagacgcctattctaattataaatgtagcacacgacaaataaaagcattttttgatgtaattggatcgtgttttattatctccaatagatttcataacgacaaaagacaaacctgatttcagaattgagtttttattgaagactgaggatgagtagctttgacaaacgtatgcggttatgtgctatctgtgttgtttaaatcgtgtcgttcgttgtatgtgtaatgcgttgcattttgggttgagtatgctttggtagtgaggttatctggatggttgtgtgagtttttatcggtgacgcggtagtcgtttccaggcagagttttgttagcttcccgactttctgtggaacttttttttttaacgtccgtagatcgttccgtgattgtttgggggtagatgttagtcgtttgtgacgagacgtgagcttttgttagtttggctgattgagttctgttgctagtcgttagctgtgttgtgatatgatttgtcgaccttagacttgtattcgttaatggttcctttggcgttgttagtaagtttgaccaggttagaatggcagactttgaagatgtcgttaaggacgtttcagcggtgaagggccattgaggtgtagtcgatttttcccatgtgtgagcgttaagaattggtgtcattcgtggtatttctgtgtggttgatctctccgtgagtggacgccgacattctattttgctttggttcttcggtgactttagtgattgagtgtgatgaattactagatggtaaagcattgttagttacctgtacttcagttttggcagttacatttgacggtagttttttttttggagtgacagacaacgtctgaacggtaggtggctcgcttgaggatttcaaagttgtcctctggaatctgtcctctttgaaggttttgacggtctgcacttctgtgctatgggtttcgtttgcgtattctgtttggttttttacgttgagaagttgggtaggatttgtgggttctttaggcgtgattcccatcgtttctccaagagaaattttaataaaattttcggtcatgttttgtacttccgtgttgtggctcatgtatgtgcgcgccgcgtcttgccaagtggtaaactttaaaatcggagtggtgtgttcggtgtcggtgaattttgtcgtgctctgctgtgatttgctcttaagataaatagagttttttggtgaagaatagatattgtcgctaatttcctcgattcctattgttgttgcgaaggtggtgctttcgagcttttgagtcgtgtttgttgccactgtagtgctctcaaacgtttcgggaattctgattgtggtattttcaaaatttgttggttttggtggactttttgggttttcggtagggttttcggtgttttgttcggttttaatagtggcgttacgacggattgtaagagttggaatgtcagtcggggtgtacatcggtcgaggaaaatctgaacgtttaactacttttttgatgctttccgttgtttgcgttgttatggtgggtgtgttcggtgtaacttttatggtgtctgtctgcagttctgtaaagttttttgttacgggggaaggttctggggttggtgtgttggtactagggatatgtggtgatgtgatagacgctgacgtcgatgatggcgtcgatgatggcgtcgtagtcagtatcgaatgaaagtttacgatggctcgtccaaaggaagtggtaacatttataggttttggcgaatgttcgaaatattgatcatttgaacggatgcatgatgttgtgttatagagcaagaagtaaacaaagctggtgtaattaaagaagatttcaggagtgaacggagtcaatgaccgtgtcagattcgagttggaaaatttactgattgccatctgcaaggattcgtcggtcagttttatgtcaaataactgtgttcccagaattttaaacggtagtagctctacgcatggtggatctgcggtatatgtagatagtgtggcaaacagaagataaaatagagaaaaactgctagcgacgatagatttgtttgcagctgttgaggatagcactattttggtttctgcccgcggtaaattctgtaatggagacaagttaaccgcagacttgcattgtaaatctcgaatgttccaagagaaaacgttagttaaaatttgagtgaagcagtcgagggatagatttctctgacaaaaagttgtatacaagtttcggaggtcgtaaaaatgttctctttgttcgtcgctccaattgtggcggttgacggttttgaaagcttctaagggatcagatgtgtattttattagattaacggagtgcatgactatcgcgaaaagggccagaaaaaggccgagtcgcgagatgtgaagcatgtcgggtgagttgaccacagtgaatttttacaaggagaatgtgtaactaaaatagtatttgctttttttatagggttggacgatgacctccaaatgcatgctgtgctggactgcgattgtgaatgccctggctatcttaatgttcttactagtaatttatcgggcgctaatcggatttaatgacgatattttcacgagcacgttgtcggcgtttagctgtatacggacaaatctatctaatgccaaatataaataaaacgtttattcaacacaatctgatgagtctatataagccgaataaagcaattattgcgatcagaacataaatgataaccaatatgatagatacttggtctatatcgattccgacttcagacatctcaaaaacagagccgtttttggctaacaaaaggtagtgcgtcctggtgttgggaacaagtaaattgttgttgggatcggtcagtgtttttagttcgtctatgttttttatgtagatgtattgtaagggaccgtcgatatcatcatattccatgactacgctctgacaaaactcgcatgtttgagatgatatgtttcgtagcacaagcagatcttgtcctgcatatttataatttgttgaaacgcaggtagaattgagaggtatggctgtgattattatactcgtagccacgattgtcgttgtaattgttaaactcactcctttaatcacataagagggagaaattacaaatgtcacattcggcagaggcagagaagctgctggctcacttggagagagacactgaatggccgctactctcgccatatctggcggtctgtatacggatagcatctccatcatgtctgatcgataacggtcgagggaagcgtacgtgagaactgtttttacaaaagaatttgttacatctctgcgtacgggagaggcacaaggcgaataaatattttctagattcggtgccttgtcagctgtaagcatgtgggcccatgaaactatttctacggggttacacaggtttccaattagtagttgcatgtgcctctgcatgcgttcatcggcagggatgaaattcgctatttcggctagcatgaatagagtttccctatcggaaaatgtcagattcgtaaaaaacatgtgtttttcatagatcttttgtagagtgttggcaatgtcagaccacttgtacctggaaatcgttacattggtttcgtacgctgtcgctaagtacgtgagcagcgtagatacgggaatggatttgtttttggtgatgtagctatagtccgagggctcgtattttaaaaattccttcatttttgggtattgtatcgtaccttccgagacgttcacacatcggttgacaaatgagtcgatggacaagagattttcgtgtgtctttaacactcttaacacgggcatcggtcctgtgttttttgtgctatatgagaaatgtacgataccgtaaagaaacatcatctgcggtatgccggcatagtcgggttttttacagtctccccttaatagggtttggattcctaggttattaaatttgagtagtagagcttctacttcatctacgtcatccaacgtttcgtctacgaatgtcgcatctgatatgaaacggtattcttcatcgactacgtctttttcgactatcaatagtagatcgtctgtcaatgtctgtttgaatatgaatgaacttttcctataaggggctttaaagtttatgtcggtggtatttccatacatcatagtcagatctcctgcgggattttggatgtacagtatcataaagtccggagtaaagaaatgggtatagatgttttcgcccgcatagcgtgtaattttagcgcatctaacttggactggaaagatcagttcgttgagagaattaggcagcttacaggaaacgttgtcgtattgcatctgtcggacttccacaaccctgatgtaataaattccgtgtgaagggtacaggtttaaggaatagacaatctgcggttggatagagtgatccaggttaaattgcttgaccgcaggtacggtagaaagtcttaaaatatcgttcattggcggctcatagaaacgtgtaacgcgtttttcataattggttaacgattctgtcgtgttgatggcatcaaacagatggtacgtgatatcggatccgagtaagcatttagggacttgatatatccgagtgtcgttttttgtataaaagttaaaagttataaagcccgggcgaacaattggattttcagagtttccatttttacaatggctctcgttcgatatggtccacggtctccaactgtaacagggagtcaacagaacaaagacccagagtcggaagagcatagttgttcttcatcgatgaagtgtgaaagggttctgctattctttgaaagttgaacactttttgatctttccatattaaatagattacaaaaatgatgtgttatggaactcggaattgtttctaaattctccgcgtctttttttctccgtcaaataacatgtctttgacaggtttgcctgatattcggaaaaaaattggacagtttcaccatttgaggatctataagcagatcttatctttgcaaggaaattttgcgcgactaaattattttttaggagatgtgtttccggctaatttgcgatcggcatctgtctcggtgtttttcgaggtgcgtctagggccacgcattccggattgtatcgtcttgctaaagagtgtagatgccaaagatgagtttgcttttcattgttatttttttgagtttaagacgactttggggaagtcgacaatgcagtctgtgcatcacaactgcattcatcaggcgcaatatttgcaaggtttgagacagttgcatcagtctatttcgttcttggatcaatatttaattgcagacgaggttttgtggaacgttgttcccgtaatttgttttttcaggcagtggggactcaagttagatttttttaaaaagttttcggggaagaccaagcggttgtcattttcgtttatatgtgatttgttcgctaggtctcaggatggcgcagtgcaatctcttttatcaatacccaattacaccaattttagaagggcatgtcagaaacatactgatttgtacagaagaagatatcagaaggcttcaaagtcagtcctcactaagacttcgggagaaaatagatcaagggcatcgcgacaagttgctaagaatgcgcctaaaaaccgaattagacgcactgcaaagaaagatgcaaaaagacagtgacgttttgaattctcatttaaaagcgatagaggatgctttgctgtttacgaatgatggggaggtaaacgtcgaaacgaaagctgatacgcaactgttaccgaaatctcctgagaggctggaaaaatttaatcaagttgccataaccccactcgacccctttataagatttacagacgattttagaggagaaatgatcaatacttttttcaataatgctcagatgtggaattttacgttcgggtcttggttttataagctcaagagggttttttacaatgagcctggcttaagaagggctttaaaaattactaatgtggattctttgactatttcgaaagagttattaacagttaccgtcaatgcgttggagcaagcgacggtgtatcctatattcggaagtgagatgtcagacctggaagcagccttgtgtatcctggcagctttttattccacttatgagaattcacagatcgacgaacgtacaaccctagtagatattataacccttctgcccgtgatatttagattactcggtagtgaaattacagcattgaaaaatgtctctccttctggcacctattttggatttaatgatccttcttgtatgaaattttttgttcccatgagaaaaggcaagcattatgcagaaaacacatttgggaatcatgtgcttgtaaagatgttgctaggtagaggagtgatgcaaaaaattcccggtgagaaagacagccaaaattttgatgttgaagctcgcttacacggagccattaagaatgatgttctggtgtattggacgtatcagctaatgagaccaaaattgggaaataatgttccaatctttatacacgatcaacattatttacggtctggcttggttgcaattgaaagtctctttttattgtggcggatcttgaactcagaaagtttgtttaacaagagagttgggaagtttctcctgacttcgatttttccacagctggagaatgttgatttcgccgaaaataactttgaagctgggaatattcaaaattttgaatacttaatgcaccattacgttgtgcctatgtacaacctgcagaatgacatatcaatttcgactctttttcccggtctcgtggccgtgtgtgtaaatgagagtgtgagattgggatgggaacataagtgtgcaggggctccgtccgatgccgttcaggttcaatctaaagaaaatccgttcgtggagtatatccgcgcacaaatggaacaacaggcggatgtggctatacttgaaaagcatgactgcattctctttcattttgaaaacggtttaaacattactctatcttttacattaccgagacagagattgtttgcaatggcctcttcattatttaatgtaaatgatacttatgatttcatctattttctagttttaggttttctgccaataccggccattatataaggcgggatgttgttgtgttgattacgtcaatacggatggggttttgaatataaagacttacagagcttttaatgaatcattgcttcgtttcttcgggatggagaaagaaacaaagtctttggcttggccagccaccgcggagttttatggctgggtattcattttttcgtccatccagttgtgtacggtggttttcctgacggttagatttaatggtttcaaagtcggtcgagaatacgctgtgtttacatttgccgggatgagcttcaattgttttttacttccgataaagatgggattgctgagtggacattggactttgccgcgagatttttgcgcaattcttctctacatcgatgatttttctgcctatttctcttcgtggtcgttggtgtttatggcgattgagcgcatcaactacttctgttacagcacaccgttgttgaacgagaattccaaggctctggcaaaggtgtgtttcccgatagtttgggtcgtatcgggagtgcaagctcttcagatgctgaataattacaaagccacagctttgcagaacgagactggacagtgttttctcgcgtttttaaggagcggacacgacatgtggttaatgttggtttattcggttgtgattccagtcatgctggtgtttttttacctatacagcaaaaatttcatgcttttgaaagatgaactttcgtccgtgactacgtatctctgtatttatttgctgctgggtacaatagcgcatctgccgaaagctgccttaagtgaaattgagagtgacaaaattttttatggtctgcgcgatatttttatggcgcttcctgttctaaaagtttattatatatccgctatggcctattgcatggcatgtgatgatcacaccgtgcccgttcgtttgtgcagtatctggctggtcaatttatgtaagaaatgtttttcgtgtacgcggcgcgaaaaggggtcggatttagaggttggaataaaaatgttaaaatgagtaaggagtttatcgtttttattcataagagaataaatcttcggcgctgattcctgtaaggtcaaatatggcagaactgtcgagaaactgtgggttttcagacatgccgcagaagactttaaagtcgttttggagaaatgaaaacagtccggctttgtgctcggctctttgctgattgtacgccagcgtggatatctcaaattttccaaacattataaggtaggcgaaccataggtgttttgcagataagccgtactgctggttctcgttcttgatccccccaaaatcggttaaagaatctgcagatttttaaaagtcggtgattatagatagctccaacggagaaaactatattgccttcgcagattatttcttccggaattttgagacttagaccaaactcgtccatgaagagaaaattaattatgtgactgacatttccgctgtagtgcagcttttttgaaatatatgctgagtgactttcgttaaacatatgtcggagtagttccgcgtcagaatgctgtttcagaatagaaaatagtcgaaaccagtagttgttgctgattttgcgattcaaaatcactatgtctccgattccagaattgtataaactctcgcgtagtagtaagatcttgattccgtgtgacagcattgatgtacagacatgttgaattaaaagtagttcttcttgtttaaagctagtcagattctcgtttctaagcagttttgtggttatgtgtaatattaaattagggacggcgtcgttcagttttatgtactgtcctatctgggtcatctcaagatgtctaaagtttgggtaggtggattcctctgtgtctatggtgaagaaccgtcggaagaatgtttagctctgcccagagacacggttcaaaaagaattgcggtccggaaatattcctttgccgttgaatattaatcacaacgaaaaggccactattggaatggtacgtggtcttttcgatttagagcatgggcttttctgcgttgcgcagatacagtctcaaacgttcatggacatcataagaaatattgctagtaagtcaaagttgatcgcagcaggttcggtaattgaacctttaccaccggacccggaaattgagtgtttaagttcaagttttcctggtctatcgctttctagcaaagttttacaggatgaaaatttagacggtaaaccgttttttcatcatgtgtctgtatgtggagtcggtcggagaccgggaactatagcgattttcggacgagaaataagctggattctagataggttttcatgcatcagcgagagtgaaaagagacaagttttggagggggtcaatgtttattctcagggtttcgatgaaaatttattttcggcggatttatatgacttgctcgcggatagtttggatacatcctatattagaaaacggtttccaaagttgcagttggataaacagctatgtggtttgtctaaatgtacgtatattaaagctagtgaaccaccggtggagattattgtagcaacgggcaaagttgccggtgatcaagttcagttaactacggaacctgggtctgaattagcggttgaaacgtgtgacgtgtcggttgtgcacgggaattacgacgccgttgaatctgcgacagctacaacggctatgagtaatcaaaatctgccaaatactacccctttgctgtcaagtccaccgttttcggattgtgtttttttaccgaaagatgcttttttttctcttttaaatgttacaactggacagcagccgaaagtagttccacctgtttctgttcatccgcccgtgactgaacagtatcaaatgctaccgtattcggagtcggctgctaagattgcagaacaggagtcgaatcgatatcacagtccttgtcaggcaatgtatccctattggcaatattcccccgttccccagtatccggccgtgttacacggttatcgtcaaccgaaaacgtttaaaaagcggcatttccagagtgattcggaagatgaattaagtttcccgggagatccggaatatacaaaaaaaaggaggcgccataaagttgacaacgacgacgataaggagatggctcgagaaaagaacgatttaagagaattggtggatatgataggaatgttaagacaagagattaatgctttgaagcacgttcgcgctcaatcgccgcagagacatgtcgttccgatggagactctacctacgatcgaggagaaaggcgccgcgtccccaaagccgtctattttaaacgcttctttgacgcctgaaacggtaaacaggagccttgctggtcagaacgaatccatggatctgctaaaactcaacaagaaattgtttgttgacgcgttaaataaaatggatagctaaaatgtgtttttttatgttgtgatcaagtggtgtttaggtgcgtgttatggggaagatctatgagaattatgactgacaaggtatatggcgaatgcccacatttccttcaaagtgaattcctggacatggtgaaacttaacacataattgtttaccgacgcgttaaataaaacggatggttaaaagttgttgttttggttttttattttcgtataaaatggtatttaggagctagttacggggaagatctatgggagtaattattgtgacaaggtatgaaacgaatgccgacgtctccttctaatatcgttaggctttgtggggtttcaggcggcatgaattccatgcgagtagattctccgggttttagaaaaaagtgcaagggtaccaaatgttctttgtcgaacgcgatgcggagtgatttcaaaaaaatgcccatgctgatctctggtgttacgtgcgcgaccgtggttagacttggtgctcgcgatactggctggcttgcgagagctacaatgtcttttacgggaccatttggagattctatgtttacataaatgttgctcatttctgtccagctgaattcgatattattccccggtggtaaaatttgcttggggaagaagaatactttgcctagttcttgcgagtaattgatgcgacagttctttttctgtgctttcatggtgatgtagagaggccgcgtctcgtcccaaatgcaggtggttatagagattccgtgcaagagtttggggataaagaaacccgtaaagtttgaatttgattcgaagatagtgtggaaagagcaatggaaaggcgtaatcaggttagagacgatatttttagttgcgccgacagttattgaaccgacgttgcattttagaagtgtttcttgattctgcgacattgtgatgtctgcggtgtggggggtcagtgaaagttgtatgttaagtttttcgggaaaaaaagtatcatcaaggagatagtcgttttcgtacactgtcttcaaaattaatagatttccacaaagtaagattctagagatggagacgtgtcggtgtgatataaattcaattttagcagagttaaaaatttggtcgagcggagtgttttggagattgatccatatatctgcgttaaataaatatcgtgttggctcttctggtgttttttctgtccatcgtatatcagccgcgtaaattttaatgcgcgtgagagggccatatagaataaactgcgcctcgcactgtccgtggggtatggcgtggcgatcgtaggcttcgatgcgttgcaccggtaaatttgataaagtcacgttcgcgtaagggagtgcgaatatgttaagaacgatgggtaatctgccgagatccagatctagatctgagatgttatgcaccgcaaagggtatgttgccgtaatcttttggatcgatgtaagtaaaaggcgatgctgcaaaactgctttcgtctctacaagtgcacaccacgctggatgaaggggggcagatacctaatccgcatttaaaatatctcagttcgccgggttttaatatggcggcagttgttaatcttagctgtagtacgtacgaagaccattgtagagtggcgggttgcatgtttgcttttctggatgtatgaggggaatcctgttagtgtattttggatgttaaatagttgatgtaaacgtagagagtcatatgcgcatttttataatagagtgtttttccacggacgggaggatctgcgggtttccacgcgcaggcttgtcttcgtattctaaaggatgtagtgtgagttccggtagcaagtatgcaggaaaacaattgcccatgaagtgtacttcgaatggcttgtcggtattctccgtgtgtgttaaaagagatttcatgtcgctgtttgagagggaacgaaacggctttctaaacaacttcttcgtcacaaaaaagatacgacctaacatgtcgtgttcggttacggaaactgttttttcgcacgaaatccgcaattttaacggttcttgggcaaaccataaaaatgggtacagcttgaagacatgcgtctgaacagggatgaagatgcctacgatttttttgttagtgaacttgccgcgtagcgtgatctctttgtttgtattaattactaaggacatatcgctgggaaagaaaacctctagactctttccgtctgcgcagattttgaaatacggcatattcatattcagcgtgacggtactccgattcggaggggaaaaggtcaagcgaagataacattctttcgtgattggaaaccgtcgctcgttttccggcaacactacgttacgtaaaaagattgtgagaaaaggatcgttaaattctattttgtagatagaaatgccgggttcggaaatcatgttgactctgcagagtggaatcatactttcgaataggtttttccaataggaacattttctggtatcgatgctgaacgcgctaaaaactattagcagctttctgccatagcggtctaatttttgagactgataaggactttctgtccagcttaggttaagtaagatcaaagacgtttcaacgctatcattcgaaacgactttaaattgatttatcacgttggttgtcgagatcggcatgttggtcaggccatattgttcgtatacgattggatcgatgttttctttttggcatagcgcattgatgtcgtcaatctccagtgcaggtgacggcagataaatgggtatggagaataaatgaatccgtacgggaactgtcctagaaataggtaaaatttttattttgatagtcattgtattttcgagaaactgtacatcgaacaggacgtcctcagtttctgattcagtgccatctgttatgaataggattcctggttttgtgcttgagattcgacatttcaacgtgatttcttggtaagaattcggaacaatgtgattgcaatcaaaaacaagctgtaagacatgatttagttgaggagaatacatgttggtacaaaaaaacattttatgtttcaccttgctttttaaatactgtgtttttttaagggatgaggtaattttacatgacggatggaggacgcgggtgttcaggcggggtgtgtttttataatcctgcgtataagtgatagaaaagtcatagtaggccagtgtgtttttaaaaagcatttaatttttataaatacatgtagccattctattatctgcggaaacgtcacagacaacaaaatacgttttctcgttggtcaaagaattaatttggtcgatcatagttaagactgatttgattttttttaattcgtctttgatgtccgtagcgtgaagttgtccgcagcgctgtgtgcttaacgttgttcttttagataatagttcttggcatttgatcaaaagcattgaatggtcttccagcgttagccgatctatgtaagttctcacgatgtctggggccatggccgtgatcatggacagcgagatgcaggctgttttcatggagtacattgattgtttgtcgttgactatgtctggtaatttaatgagtacgtctctgtattggatagagcataactcatcgatgattgtttgcatctcattgtattctctgtgaactgctataagaccaatgcatagcaatctgatgttgatctcggccgcaatggcggtcggaacgactaaaggtacagtgagctcccaatcacccagtttcaatagcttttcttccgagtgcgtcgataaaggtggaatcaatgtcaaggtgtcacccttttcccaggggaagggtcctgtgttctttatggcatactgctggccggtcatcggctttctcaaaattagttgattaccttccaccttctgcagaatggttacgaccatggtccgtaatacgttccggatgtggacgtaatctttgttggaggagacgatgggataaagacctaaattgccgctacctattagatggtggtgagctgggatcggtatgacgatgttcatgagcttgcagagggtgctgatatcggaaagtgacagtttgtgatcgaaagtgcagtagacggtttccattttatatggatgattcgataataagttggagaggtatggtttctcctatggcgtagttacaataatgggtttcgctgatctgcgtattgcctgttttagaccgactctctaatagagcttggttggatgaacagtgaagaggcagagcgttttgtaagaactggcatggtctgcttacgaagctatccgtgccctcagagcacgagtattgtatttcgctatcgctgtttaaacatgaatttgatttcatgcagtattcgtttatcactttgtacatcatcttgttcgtttttaagatgtcagattcggtaaaaaattgagcgttaggactgtatgtcttgggattgtaacatagttgttctctgtgtgccgtgttgtacaggatatcgcctaaggagcctggtagagatgcccaaggatttgtggttgcggcaaatgtatcgctgtctgtttgggtgtgatcgtacaatgcttttctagccgcctcttcgttgtgtgggtccgttcccatcatacacgattccctgcctctggggttatggggcaatttgaaaaagttaatatttgtcgtgaccggagtcagtacgacttcgcagatagcttgttgaccatgcagcagtatggagggtgggtttttgttaattccgccgaatgttatgatgtttagtgcctcgccctcggagggattaggtttttctatcccgacgtgatgccgaatccacgtatttatgtccgtgttggtaaacgcgtgtatcgggaaggcggagaaaaggttttgtatcttgcttcccatgtctgatttaattcgcttaagattggcagtggcggtggtagaactaaaacctaagcccatatctacaaaacttagatgctgggtgaagttgtaagtggttacgatatctttagcttccgcggtgaccgtgggatcgtctaaaattatagatgtggctgccctggagctgtacaacaggcactcgacgtcgaaattatccgtccggactagtgtggccgcaaagcccggatggattttgcttttgctttggatcgctatggcaacgggagacagttttgagtgcatggcggcaagcgtcataatgctcaacagggaattggggcagaaggctgagtacacggaaaacggtgttcgttgccaattataaaattctaatgctaatgggggcgggagaggaaaaccgccgtcgtttctttgatagtgaggaaatgtatttaggaaaacttggatatcagcattcatggtgccgcagattcccgggtcagagaagaatcgatgaaatgggattggctgatagtaccgtcttagggtggtgatcggtgagatcaggcaaagcccattgtatagaatgtgttgtagtgattgaaaatgaacggaattgccgtgtcgctgcgcagggtctaaggagacctccacttccagtattttcgtattttcattaatgtagattagcgatttaaacagctgtttcgcgatagatgatgtattggctatggtgtagccaggacccatagcttctcgtatcagagacattaggacgtcgctgctgatcggattctcctggaaacaatcatctggacagataaacggttccgtgtagaataagtctagaactagttcctttacgttgacgccagcgccacaggccttgttatttgatagtgccgggagtacgcagaagtaaaagatcttgctcaggatggtgttttcgttcgatggtctgtcattgtcggtgaagacgacgcttgaatctattagattcattctttgcacatcggagatttcgtaatttctaactcttacggtgttctgtgtcagtggtgtatcatccgctgttatttttgcattcgtgtcgtttctgggcatggtatgaacgaacgggcagaacagacgtccgtcgaacaatgcgttggcgaaattcaccagaggttcgccgcaaagttgctcgttgatgttggagatagagattgtcctcttcactaggcgaattagcgacacaagatttctgtagtgagcgaaagctgctcctgggatcagttcgtcacccatgtggttagagattagcatgatcatctcgaagctgttgcaaaaaagaagtatatgtttcatgttaaaccaataagaaatacactggctaattacttgttttaagatcatgaaagcatgcttgtttccatgaactaagatctcgataacgtaagccaattctgggtacgagccactcgtcaagctttcggtgacaattttgagggtgaagtcgtagttgtgggagtttgtctttgcatgttccagcatttgatttgtacgggcttcgtggaaagagattggagctagaggtaaaggcatgttgcctatcattattcttggcgtgcagagtacttctgtggctcggtttttctggatatacgtgagatcaaagaaggggtgtctttcggtcggcagagttggattgtccggtttgtaaaagtcttcaacgtttagttcgttttttaagacgttggtgtttttgggtacttcttgtcgactttcgtataagttgtataaggtctgtaagatcctggttgggttttctcgggtaattttcagttgacatagttgagaaaagcggtggccggtaggcaatggttcgtttttcatgagtcgttcgacgatggtcgagtcgtggacaatgggatggcaaaccgacggcagtatgtcggcaaaatcaattcgctgcacgacttggtctttattgtggaaaaaaacgctggtgggtaggttgttttccatggtgtcgtttaatttcacacgtgtttccattgtactgaaaccggtttctgtcggtatgtagatacccaaagggaaaaagaatgtcagttgtaagctttgttctagcggatcgttgacgtctgtgtttttgtaaactttgtgtaggtggtcgaatgcgactaatttatctcccagttttaacgtgttcagttttaggtcggcgtacgcgcggcttttgtcaaagatttctgatttgttgttagtgtcttgttgttctgtcccggcgttcacggtgaattgagtaaaatcggccatgattgcacggtatgcaatcgcagtcactgcgttttctttgcccataataaagtgaccatatgagatgggggcggagacgacctgtgtggagatgtactgggagagtatgttggtgagtttttggatagagccgatcggtcctaataaaacaccgtctagggggatgttttctttggaagtgtagttgttcgtatcatttagaatgctttccgtgaccgattccatcatgtcgttcagaattctatagatatacgaactattattattcctgttcaagaaaaataatgacgttaacaatctgttttttaggctctgaaacatgttgctgcgctgtactcggctcagagcttgtttattatgtactttgttctcattcatggtcaggacgataaattgcgggggagattttctcaataaggtttgcatgaatgcgtgaatcagacctcgttcgagcgaatcggctgaattctttaaagatcttaaaactgtatgcaacgcattgatgtttaaaatctgatcgatgactgtgtttttaaaagtgttttccagatgctccagacaggcagcactcaaatcgaacgatatgtttatggggtgtttttctgagtgtttggctaccatgatggtggtttcttttggagcagttacgtcgtttcctgtggcgactctgggtaattggataaagaagagaaccttcccgagggtcattcgactcacatcgttgaagcgaattacgttcgccgcaacggcgatcggcgtggtgaaaaagttgatccattctattttgttgcagtagattccgagcaaggcttcaaaactgatgttgtaacggctcggatcgtcaccgaaataaattcgcaaattgtcaaaaagttgttcggccgtgtatgttttaatgtcattgaaaatatttagaggtgcttcgattttaggtaaaatttcggtcgcctgccaattttccatgtttcggcgttatgcagcacaccggtaattgtgaaactttaatagttaattcatgttttggttccacttgtgcacggtcgattccagtttttatagattcctgtgatctgaccgctgaagtgtctcgcgacgaggaaactcgtttagcgcgatctgtgcctgtagttctggaaaagatcgagtcaatcatagagaaaatttttcaaacgtctgggccaaatatcgttcacgataaagacagggctaaaattgccttgtgtcgtctgttgttaggaccggttgcggtgccatgtttctgtgaagagtgggacaccaacgactatttatcgaaatctggatgtaaatgtctaggtccgatcttatatattcataccagtcgatgtcgctgtagcgatattccggtttttaagttttccattatgaaagattactacgcttcacacgtgttcagaggtttattatctctgaaagagtggaatacacatctaccgaatgtattgtgtacgtgcgagttgtcgatgagcgatagatatgtggcgaccgtgtttcctaagcagaattctatatatctagaatactatccgtattttttgtgttatctgtgtcgctatcttactgtcattgagattgagcagtgtacaaatgatttaatttcgcttcttggtcctaaagtagctcagcgagtcataattcattttaaactgcttttcggttttcgtcacaagccgcatatgggcactgttgattcgtggttctgggaaaatttttttatgctagaattgcataagctttggttaaccgtagtcaaacataaccgggtgacaacagatttctttaatgtagtctatgagaaaattcaaaactataaacaatacgccatcaagactttgagaatgtcgtctaaggcggttcctgcaatacagaggttttgtttggcaaaatttaaacagcaactcttgtatctaaatattaaggttacggtaaaaaaaaataagcgagaactgtgtttgaatggttttgtttacggtaaaacattgtatgtcgttgaatcttctcagttaatatttcgaaatttgcttctgttgtattacgattacagtttgccgggcgaatgcaaaacaaacgaagaaaacgttttgacgactcattacatacgggtaatttcgagattgtcgtttaagcagtctcgaagtgcggtcccgccaggcgtgagaccagattttaccttcgtggcacaactgcctaaacgtaaagagttgcctaatgtccccggtggtattgattttgctgaaattacctcagtgaggcatggcgcggtaattcttaacgcgtttaatacgaacaaagtcatgaatttaaaagcaaccatttcaaaaagggctaattttgtgtatcatcgcattcctaagacaatgactcacagttttgtcatgtacaagcatacatttaaagaacctgcgtttactgtaagcacgtttgtttcaaatgatgatttagatatgagttcattgaatatcaatatacgtggaccttattgcgactttttatatgccttaggcgtttataagatgcatgtttctatccaagatctgtttttgccggcgttcgtttgcaatagcaataattcagtggatttacagggactggaagatcaagatgttgtgagaaatagaaagaaaaaggtgtattggatcactaactttccgtgcatgatttctaatgccaacaaagtgaatgtgggatggtttaaagcaggaacaggtattattcctcgggtgtctggcaaagaccttcaaaatgttttgcttcaggaattaaataacgttcgagagattccagggttagtctttgatatggatttgcatcaattgcttgttttgctggaacagcggaatctacatcagattccgtttctcgttaaacagtttcttatttttttacgtcttggcctgttaatgggttacgggcactctcggcgtaacaaggtgcatgatatcatgttacacttaatttcgaatggcctttttgattttaataagaactccgtagcaaatacaaaaatcaaacacgggtgtgctttggttgggacgcggctcgccaacaatgttccgaaaatcattgctaggcagaagaaaatgaagctagatcacatgggacgaaatgctaattcgcttgccgtgttgcgttttatcgttaaaagtggggaacataaaaataaaactgttttcattaaactgttggaatatttagcggaaacctcaactgccataaatacgcggaatgaagtcgccagattacttcagactctgacgactaatatgaaaacatgaatgtacccatggccgacgaatggttcgattgcgcgattaggttagattcggaaaccatagctgtccatgaaattttcaattcggatttaagtaaactgcttaacttgcactcgaaaacggtctatatgtccgatctgtgcgcctttatttctggttgtgttaatcggaatgttggtaaacttaccatatattggcacgtgtacggagacataatctacgcattgacgggtattttacattgtgtaaaaataacgatagagtgcggggagagaattgccgatggtcgatatagattatacgaagttccgaaattatttttaatgagaggacagtcaacacccctggaactgaagtggaagcacgccgtgggtatcgcgacgacgaataagcctttgctgacgcacgttttaacagatgtgttggaaacctctccttttaccttgccagatacgcttctgtcggtgcaggagttgtctattttcagagagagattgtcgtatatttactatgtgctcgggttagatgttgatatcgtagcgcggacagagagggagatttttcaaaaatgtgcagaactagctcgcctacaacaagtctttcttattcaaggaaatattatggaaaactttgtcctcgttcaggcgtgtctatttcagctgggggctgatggtttgtgggaagagatgtctggctctgtacgtcctaggccggagttgatgtctagtgcgttcattcaacacagagtaatggtgaataattgttattgtctcgctgtcatcttcaatgccatttataaacacaaagtttccctgcctaccgtagaaagaagccacgaaatcgttcatcgtgtagttcaggaatattataagtcttatgtgaatgctcctctctctgtttttgtgtgtgcgactaaggtgcttaccttgtttacagaagaatataactttcagtcagctctcgtatttgtcagtcagtttttccaggtggacgtcgaggcttcgagagcggatgtgattcgtctgtttttagcgtgtctgaagggtgattagatctctcggaaagaggctgaactgtttccagagcacacataaatcgccataattatggcgataattaagtcgtcagaacaggcttgttttttagcgctgtatgttatgtaattgttaacggagatctggtgaatgtttctgatttgttctagtgcgtattctacgggatcgtaggtgatttttattgtaaacgatatcaattcctgtgatgccttgatgtttcctgaattaaaattcgagatgaaaaactcaactgctagttttttttctttaccgagtaggtaaaatggctgtgctatctgattctggtctggggtgtggaaaaaagtcacctgtatagatttattagccgtgatgttttcctttatgatacatgcgatttttacggcagaagcttgattggaattcccttctatgatgatttttacttccgtgaagaaaggatgtaggtctaggattgacaatatcatatgcgcggcacattcagctattgctgtgtcggaactcgtcattaaactttctagaaagtagtgctccatgccgtagacgatatattgatctagataggtgcctatcgctgctatgccagtgccagaagcacggcggttgcctgtataggcaggatctaggtatacgtacagatctttacctaaaaaaggaattagatttttattgatggtgctgtatcggaaaaactcgaattcggtttggccttgttccgtaattaaaacgtcgttgatcacattgcaagtggctccgcccatgatttcatggatgaaagctccttctaggaagaggttggccgtttttttaacttcggcgttaatgctgatgaacttgggtttgtggagtcggtagcaagaacaggctgtggcgttaccgcgttcgtttagcatatgggcgtgatcttcgcatacgtaagaaactacggagagcatttcaaacggagagttgttcagcttcattaaaaaagaagttgaatggtttccggaattggtcgaagatataaataggatcttggtagatgcttggggcaggaaacctaaaatcgtgctgaacgcgtctttctttataaagtggctctcgtcgacaataagtagattgaagctttgtccgcgtatactctgagaggggaatgaattcggcgttaaacgagataaaagacgattttgagaactgtgaaacgaaaaacgacctttttaaaataattgataaaataagcaaaaattgcaattttatagtggaacaggtcgagtccttgcctcggagggtggattcagcggctatcctatttgataatctcgcggtggagatatttaacgatgtaatatatcgacaaaatggagatggcgttcccgcgaaaatacgacagggtaacgggcagaatattgacacataagaataaccagatgtgcacaaccgaatgttctcagatgtataatttacataatcctatcacgtttgagttgggacttggaaacgtgtttgtctgtatgcggtgtttgacggttcaccactgtgatatgcaaactgactgtaccattgtcaacacgcatgaggggtatgtctgtgcgaaaacgggtttattttatagcggttggatgcctacatatgccgactgtttcttagaaccaatctgtgagccgaatatcgaaacggttaatgtcgtggtggtattgttatcttatgtatatagttttctgatggaaaacaaggaacgatatgctgccattattgatagcattattaaagatggaaaatttataaaaaacgtggaagacgccgtgttttatacttttaatgctgtttttacgaactcaactttcaataagattcctttgacgacgataagtcggctttttgttcagttgattataggaggacacgctaaaggaacgatttatgacagtaatgtaattcgcgtcagtcgtcggaaacgagaagacagtttactaaaaaagatgagattggagtatggaaacgcacttatactatgacaccctgtaccaatatcaaggcggagtgtatccggcccatatttgcctgccgacagatgcgtatcttccgatgagagtggattgtatcgagtctttatattttcggtgtgtatttttcaagaatgggatgcattatactgaatggagtaaattaaagtttactgtgatttcacgtgaaataaagtttaaagatgtgttaaagaatgctgactttgacgaactttttaccggtttggtggtaatgactattccaattccgatagtagattttcattttgatatcgattctgtaattttgaaattggtttatccgcagttagtgcaccgagaaatagtgctgaggctctacgatctcatatgcatcagaccttcgtcagaccggccgtcggaagtatcagctaaaaatattggtattgatttctatcaactaacttcacagggaaatagacaaacacccgatgaggaaaaacgttgtctattttttcagcagggacctttagagccaccctctaccgtcagaggcttaaaggcaaccggcaatgcaaagccgatgcagattcccgctcatgtcaacgaaaaaatgaccgaatcttttttaagcgatagttggttcgaacaaaaggtcagatgcaaaaaaatattggattttactcaaacgtatcgagtcgtggtatgttggtacgagctttcgttttcccgcgagatgcagatcgagaataatttactgtccgcttcccagctaaagcgggttaacgctgcggatttttgggatagaactgatcggtatttgcgagatattgggagcagggtattgacacacatcgtgaaaacgcttcagattcataataggcaatttaaacagaaatttaattgcaatttcccagttaatttcagctttgaacatctattatcatttatgcagctcgggaaagatttttggattttaaacttaactttagacagctgcattattaaggcaattatctgtttcctaggttttcgaaacgggagaaaatcttttttagctcaagatgaagtttggggagatttaatagactgttctaaaggatcggtgatctatggggaaaagatccaatggattttagactcgactaacaatttatattcgacgcgtcgtgaaaaacagaataagtcgtgggaattatatgttgattgctgtgctttgtatgtatctgaaaagttagagttggattttgtgctacccggcggttttgcaatcaccggtaaattcgctcttactgatggcgatatcgactttttcaattggcgatttgggttatcttagaaattttttgcagaatgaatgtaactggttcaggatttgtaaaaaaacattctatcgcgaatatcgcagcgttgcgacatcgtctcctatattttcgttgaagaataagcctaagaaatattgcatgcattgcgagatggtagtgctcaagcgaagtcatgaatttatgttcagccttgcggtaaacggcatacattttggacagtttttgaccggaataatgaaatttaagaagaaacaggttgcggaagggctctgttactatgtattggaattgggaagcataagccctgtggatttgagctttatcccaaaatataattctgactgtgttacaagcatgcattgtgttacaccggagcttatttatgaaaattgctctattgtgtgtcccgaagaggcaagtcgcctcacagtaaaagggcccggggacaataaattgattcctttaggtgggtgtggagtatggtgtctgaaaaatggtggcgatctgtatatctatgctttcgtactcgtttacgatctttacgtagcttgttatgacaaaaccatctttccatctctggcaaaaattgtttttgatatgatagcttgcgattccgaagattgcgtcttttgtaaagatcacaacaaacatgtatcgcaagccggacatattgtagggtgcgtctctaatcaagaaacctgtttttgctacacaccgtgtcaaaaaaaaatgactgatattaacaatccggagttaatctctttgctctgtgatcaggaaattaataagatagatattatgtatcccgagaaaaaagcaccgttatcacttgacattaattcttacgttcatgggtacatcggcgacgagccttgtgcgttaaaatgtgttaattggatgccaatcaggatcagctcagctctgagcaggctgattattttgtcatgtcctgtgtgtaagcgtgtggtaatggactaagtgtgcgttattttctgtattaattttttgtttctgaaaataaaattgaattgatagtacttacgtgtgtattgtagcagctggcgaaaagtgctgtgctctttatattttgatggtcgattgtaattacattatccaggcatgtgattgtcttttctggaaacattcggcggcatttaaactcgacttctttcatcacaaagtgagatacatgtttttgatgtgctacgtaaccgatgctgattccttcaatgtttttcaataaaaaacttataattggaactatgaaccacgtttttccatgtcttcttgggactaggaatacgttagttttttgtttcagcgtattcagagtactttcgtttacgaattcaatgtcgaacacgtgggtcagatagttgataacacgattggctaaagccggaagtttggtgacggcgatgaaaaagattacatgtatgagaatgttcttctgaaatggttccagttgtattttgcgcgtgtctccaaactcgttgaattctcctttgatccattttctgaaatctttgataaaaccatctatttgcaagaatagcggttcacgatatagaatcttaaaggattcgagaaactctgtgtattgtgattcaaaggatttgtcggaagcgggtaagaacttcatttcttgtagcttgcgcgtaaggctcggtagtatagtaagaggcttacggtttttaagatgtcgctgtttttcacagaatgtatatagaggttttacctgttggttatatgaatgggctaacccgagttctggcgtgagcattataaaacgcttcttatagaagatggcactgttggggtatttggtagatatcgtagaacagtttctttcgcctttccatatgatcgcttcatagttgttttttatgtgggttatgtcgcaggtacgtagcatggagcccgaccttacgctggcggcggtctatcaggcggcggcgaacctcacagagcaggataaggagattttttccgaagcggtaaaaactgcgttttcagtgtgtagttcggcagccccgagcgctaggttgagaatgatcgaaacgcctacacagaattttatgtttgtgacgagcgttattccttcgggtgtgccgtctggtgaaaaaaaaacaaagttaaatatcgatgccgctctggataatttggctttgtcgtttgcgaacaaaaaatcaaaaaagatggctagaacgtatttgctgcagaacgtttcgcggactcaagatcaacaagttgccatttcggggacgtacattttatatacaaaaaaacacattgaaacgtctttgatgctcgataagacgaagttagttaaacaaattcttgagtatgccgagacccctaatctgttagggtataccgatgtgcgtgatcttgaatgtttactttggttggtgttctgtggccctaaaagtttttgccagtcagacagttgtttcggatacagtaagacgggatataatgccgcatttccgaatctattgcctccgtatctgtacgaatgcggccagaataatggactgttttttggcattgtgcaagcttacgtgttttcttggtactcagattttgatttttcagcgctagagatttcagaacgcgctcgtcgtcgaatcaggtcactcctgtacgacttaaaacagaagttttcggagcaagaaatttctgttttaccggtagcgtcacagatgtgtatcttctgtgcattatataaacaaaacaaacttagtctagaatacgtttctggtgacttaaagacttctgtttttagtccaattataataaaggattgtttatgcgtgcagacgacaatttctacaactcagatgctgccaggtacaaagagctcagcgatatttccggtatatgaccttcgtaagctgctcagtgcacttgtcatttcggaaggtagcgtcagattcgatatataatgtctttgaaggactatctgagacagtcaatttctaaagatttggaggtgagacatcgagattctttaaagattagattaggggagagacatccgttgagtgtgcatcagcatatgatcgccgctaggcagatcattaaatcggacaatgcggaacaccagcatgtcatatcttctttgagtggttttttggataagcagaagagttttttaaaagtgcaacaaagagctttaaagcagctagagaaattggacgtcgatgaaataattgatacgacggcggaagtgaaagcggtcagtaataatataaaagaaactcttatggcaagcactgaattagaataattatggacaacggtgtggagacacctcaaggtcaaaaaactcagccgataaatttgccaccagacaggaaaaggttgagaaaacatgacggacttggaaaaggtgttaaacgaaaactttttgccgaagatagttctccgttaaagaaacagatccccgcctgcagcgatatggaaacactttcttcgcctgtaaagtttggatgcaagtcgcgaagtgcttctgctctcgatgaaagtttcggaaaatgtaaacacgaaactgcttgcgattgttctgcgatagaggaattgctttgtcacgagtcgcttttagactcgccgatgaaactgtcgaatgcccacaccatgttcagctcagacaaatggaaactggagctagagaaaattatagcttcaaagcagatatttctagacatgagcgagaatgttgaacttgtggcctacggcgagactttgtgtaacctgagaattttcgaaaagatcagctcgccgtttttgtttgacgtgcaaagcgaggagcgttcgtattcagtggtttacgtccctcacaacaaagaactttgtggacagttttgtcaacctgaaaagactatggctcgagttctcggagtgggtgcctacgggaaggtgtttgatctagataaagtggccataaagacggccaacgaagacgagagtgtcatttcggctttcatagccggtgtcatccgtggaaaatcgggagccgacttattatctcacgactgtgttattaataaccttctgatttcaaattccgtttgtatggatcataaagtgtctttgtcacgtacttatgatgttgatctctataagttcgaagattgggatgtcaggaatgtaatgaattattacagtgtgttttgtaagttagctgatgctgtaaggtttctaaatctgaaatgtagaattaatcatttcgatatctcacctatgaatatctttataaatcataaaaaagagataatctttgatgccgtgttggcggattacagcttgtccgaaatacatcccgagtataacggcacgtgtgctattgctaaagagtatgacagaaatcttcaacttgtgccaatcagtcgtaacaaattctgtgacatgtttaatcctggatttcgaccacttgtcgccaatgcaatgatattggtcaatgtatgcgaggcttttgatggtgaaaataatcctcttagacactgtaatttggatctgtgcgcctttgctcaggtcgtattattgtgtgtcctgagaatgacagataaacgcggatgccgcgaagctcagctatactacgagaaaaggttgtttgcgttggctaacgaggcctgtcgattgaatcctcttagatatccatttgcttacagggatgcttgctgtaaagtattggctgagcatgtagtgttgctagggttattgttttaccgagacgtggttgatatatatgaaaaaatatacgattttctagatgaaagaggggaatttgggttacgagacctgtttgaggcaacttttttaaataatagtaaacttaccagacgtcagccaatcagaggaggtcttgcgtctctacagtcgtccgagtatggagaaaaacttttacatgaccttagagcgttgttcttgatcacttcttctgcagatctggataaagatacatcatctctctttcagatgtgatatagtaatggatcttaatcagatatctgaaacactaagtgccgtggcagaagaagagcctttaaccatgtttttacttgataaactgtacgccatacgggaaaagatcaagcaagttccattttcgattgttcgcttgtgtcatgtttactgcatgctaataaaatataacgcttctaacaataattgcattttgggccgtaaacttattgaggaaatgcagcagtttttgtgcggcgcgagagtggatggatcggaagacgtttctatggatctgagtgaattgtgcaagctgtacgattactgtccgttattgtgttctgctctgtgtcgtgcgccttgtgtatttgtgaacaagttatttaaaatcgtagagcgtgaaactcgggggcagtcggaaaatccgctctggcatgcgttacggagatataccgtgacagcaactaagctgtatgacatctacacgacaagaaattttttagaacataagggacagcagttttttggggaagcggtgatttacggcgcgaaacatgagcgtgttattagacacctagtagcgatcttttacgttaaaagggaagtcaaggaaacgttgggattgctgcttgatccttcatctggagttttcggtgcgtctctagacgcgtgttttggaatttcattcaatgaggatggattcctgatggttaaggaaaaagccttgatttttgagattaaattcagatataaatatttacgggataaagaagatcactttgtttctgaactattaaaaaaccccacggagaaatctttttcggattttattttatctcatccggtgcctgccatagagtttcgagaaagagggaagattccgtcatctagagaatatttaatgacgtatgattttcaatatcgtcctcagagaaagttgcgcacttgccccactccagctattttgacacctcatatcaaacaactgctgtgtttgaacgagacacagacgtctacggtaatcgtttttgattgtaagagccacttgagtgagcagaagctgtctgtgtttcagaaggctgtgtttaccgtgaacgtattcgtaaatccgaaacacaggtatttttttcagagtctgttacaacaatatgtaatgactcagttttatattaatgatcatagtaatccagaatatatcgagagtacggaagtgccttctgttcacattgtgacggctctcttcaggagaagaacagaggaagaaaggagtttgcatttggtaattgatgagacggaatatatagaagaagaaatacctttggccttgattgtgactccggtggcaccgaatccggaatttacttgtcgtgttataacagacatatgcaatctgtgggaaaataatatttgcaagcagaccagtttacaagtatgggcacaaagtgctgtaaaccagtatcttgcggcatgtgtaagaaaaccgaaaacaccctgatggattacaagggaaatcctatattactgacgacggaatttactgttttgaccgataccgaatcggaagaggaagggatggcagatcttgaaaagcccctgcttgaaagagtacaggccacattagctgctaaatgtgatacggaagttgaaaaaaaactgccgcttaaatcaaaaaaatgatagacgacgcagatttacgacacgctcgtattttattttgtggctatttgacaataaacatgattgtaataaaaaaaagtgttattcgttttcatccattaggctcgagctttcagcgttaagtagttgcttgtaccgacgcttctttttaactaggtagcgtacgagtcgacaaattatgaaaccgatcgaaattatggcgacgaccgataaattgataataagtcctgtgctccactcggattcaaagaaagtttcgtactggagaatagggaaagataggcctacggcgccacaaaacataccgacgtaatagccgaacaagggtttaacgtagcgaaccaggacggcttctattactatactatatatgcaagccatgacaagaaaggtattgatggaagagaaagcaacggtgatggaacgtatgtagatactatttccgacgcccaggcaagtagtaatgccgagaaacatcgtagagtaacctagcatgagttcgcttagattgatgacaacggtcttgaattgtacggtcccctttaggttaggatgaattttctgaaaggcgaaaaacgacttgtccgctgactgaaattgcgttatcagcgtaacgttaaaggtggtgaaacacacgaagaagatggaataggcaaatgcacctagggcgaccagtctgaaagacagggcggtgacgaataactgaaatgtatccatgattaagatgaattgaaagcaggatgaggtgtcccccatccaggtaatatccctcgttgtttggttaacgttagatgttttgttagaggagaacacttttgcacagcagacaatgtaataaataataatcaggaggaataagatagccattatcagtacgtagcatataatctgcacagggtttatgtaaagttgatgcgtcatctgatatatttcattattagcggagagattgaccgctttgaggtcattgatttcaaagtaggcgcacggaaatcctaaatttggaaagtttatggctatcagatggaccgtgacgtttataaatgacaaggctgcacagattatagagaccagccagatccgtaaattaatggtgtctacacgactggaggccataccagctctgtgatggagaacaggtttcagaacgatactctgttctcagagtggttcggccagagtttgtccgatgtaagatttccggacaatgtcaccgtttattctcaagccgactcggcggtgagttttgaaaacgtcaggcagccgataaaactggttcgcgcagcgatgggttcagggaaaacaacagctttgattcattttttgaaacaggtacccaaggaactatctgtccttttgatttcttgccgtaaaacgttcgctgcggaaattttgcaccgttttactctcaatgggttggaggattttgaattatattgcgatattacggagcggcagataaacaacagaaaagtcattgtccagatagaaagcttgcatcgtcttacagaaaattacgatgttttaatattagatgaaattatgtcgattataaagcagttttattccaaaacgatgacaaaaaccaaagaagttgattgcaagtttttatcgctgatcaaaaattccagtcatgtaatagctatggatgcgacgctgactcggcatgtggtggagttttttgccgcgttcaagccagatactcaaatcgccctcatcagaaatacatttgtgtccgcgatgttttccaatagggtcgcttacttttgtgacacgttttttggtaaagagttttctttttttgcgcgcttggaagacaagctacgatgggataagaaattgtgtttgttttgcagcaccgtgttggcagcggaatacatgcatgatttgatacgttctcggttttcactcaaaaaagttcttttgttgacgtctaaacaagggaaatgctcttccatagaatcttggatacggtatgacgtagtgatttatacgtccgtcgtgactgtcggtctgagtttcgaaccggtttatttcagctctttgtttgtttacattcagttggccaaaggagggccggacatggtttcaatatttcaatccattggtcgtgtgaggcgagttatcgatgaagatatatacatttacatgaatcccgtactaattaaaagctatgatcctttggcgcctattgccatgcctccttgcagtgattggagtgtcgctgagcagtctatcatctcagagagttgcattgacttccgcggaaagtgcagcggagcgcataaatataatttctgttccgtactgaagtgtctttttcgatacaggcattatatcgaaaagactactattacaagtttatcagatagtctctttctgctctgcagtctgttatgtgagaattctattaaggtggacattgttggaaatggattcccgatgcgcaaagaggtttttttgagtttcttgcaaattctagttgaggagtgtcattttatcgaaaagaagattactttgccgggtgacaacatgacgtttcaagagatcataagtagcagagaaactatcatgaacggagatttttatgaaaacggtaatcagctattacataaggactatattaccgacatgggaaagttcagagcgacttttttatctccgggcgttgacattttcattgcatcggacattgtatctgatctgaaaaatgaaagcaaacgctatgtttttgtgaacgtctggttacaaaaatgtgtgtctgctggtgtagaaagcacgcgaatcgaaagagtttttactgagcgaattaagtcttatgtgctgccgaagagttttttgtgcgatgagtactttgttctaggtgacatctctggggtttacgagtggggaatgttaatagatctggccttcctggcggaaatgatccgaaaagatttgaaactgaaatcgtgcacagatactactactgacatttctgaagatgatctccttttgtgtgcggccaggaggtcgagtgacatcttacaaataatgcaattggtgtttacggtgcatgtgcaattttttcaaagatacagtctgcagactctgcagctttttaacaagttgagaggcatgcggattgtgacgggtgtgttttctatagaaaaattcagcatttccatcctcaggcttttctttaaatgtgcatttaatatgactttgtccgccagcaaacctcggtacatcccggggaaggcgtatcgcaatctaacaaaaaatgatctggagaacatgctagacaattgggagatttcgcgcaccaatcttaagacttgtaaagaactacgtaaagccctcaccgaggcctcgagagcaaggcggaaacaaacaatttataaacttcaaggctcggatataagcctttccgttagtgaagttggagtttttgggcaacatgcatctccgggggtgtgcgtgtcatcttagcctttattgtgtgtacaacgactgggagaataagatctacagagtaccgatttttcagtgtttgtttttagaagcggagactcgttcgttaaaaacgtttttgattaggggacagagcctagaccaagaatcgttaaatgagatagaagttacaagaaaagaaacaatgctttgggaccttcaggaacaaagtaatatgatggacaaaaaaatagcagcaatcagcagcctcattatgaataacggagagcttcttaggaaactttcaaaatttttcgtgcctctaactgttgttcttggagacgacgggttagagattttggaagcatacgtctgtggcgaggaacccatgctgcctttggacacggtacctgttatattacgatgtgtcggagactacgcagccttggacaccaagcatctcttgagtaacgaatgtacacaggcgtctaaaaaacttcgctttggatacagtgtaatggactttcacttttcgctaactgtgtctgatgtaaaaatttgcttttcacacacggacaccggtgaggctgtatgtgaaaaaatgaaacaaattttttatttttctgtgtgtgcttttggtggtgagcaagttctcttagtgacgccaaaaaatgcttatgccttattgttcgacgatgatttgtgtttgcttttactgcagagcgtgtttgctttcctgcacgagaagatattcggagtttataaacaggtgttagttcagctttgcgaatacatcggtcccgacttatggccctttgggaatgaaagatcggtttcttttataggatatccgaatctgtggcttttgtctgtatcggacttagaaaggcgggttccggatacaacttatatctgccgtgaaattctctcattttgcggtttggcgcctatcctgggacctcgtggtagacacgcgatccccgtaattagggagctaagtgttgaaatgcctggaagtgaaacctctttgcaacgtttcaggttcaatagtcagtatgtttcaagtgagtctctgtgttttcagacaggtcccgaggacacacatctattctttagtgacagtgatatgtatgtagtgactttgccagattgtctgaggctattattgaagtccacggttcctagggcctttctgccatgttttgatgaaaacgccacggaaatcgaactgcttttaaaatttatgtcgaggctgcaacacagatcgtacgctttattcgatgcggtgatctttatgttagatgcttttgtttccgcttttcagcgagcatgtactctaatggaaatgcgatggctgttagtgagggacttacacgtgttttatttaacctgtgacggtaaagattcacatgttgtcatgcctttactgcaaacggccgttgaaaactgttgggaaaaaattacggaaatcaagcaaagacctgcatttcagtgtatggaaatttcgcgctgtggatttgtcttctacgctagattttttttaagcagtgggttgtcacaatctaaagaagcgcactggacagtaacggcaagtaaatatttatctgcatgtattcgggccaataagacaggtctttgctttgccagtataactgtttattttcaggatatgatgtgtgtttttatagctaataggtataatgtttcttattggatcgaagagttcgatcctaatgattattgcctggaatatcatgaaggacttctggactgcagtagatatacggccgtgatgtctgaagatggacagcttgtcagacaagcacgtggaattgcattgactgacaaaataaacttttcttattacattctcgttacattgagagtgttgaggagatgggtggagagtaaatttgaagacgttgaacagacagagtttattaggtgggaaaacaggatgctctatgaacacattcatttgctacatttgaattaattttgtttctttacataacatagaaaaataagacttagctagacgtgtcttcattcttcgaataaaaaatttgtgcgaattgtgttgctagttgtatgacttggagagaactgtcttgcagctgtctagattctaaggataaattgatgaaattgtgactacgttttgtgttaaaataaagttccaaaacttctatatgcgtgtttttcatttcattgtatagtctaatcatcggaggcaccttgtggaggatttctgaggcgtgttcgttaaaaaaaatgtgtcttagtgtacaaaccaatttgtcgcacgtgttgaataatattttcgttaccggagataggacggggaaaagaacgagcctagcgattagtttgtgcagggtgctttgcttcagtggaagattctctaatgcgaacactagtccgcaaagcataaattcttctggcgtatccactttcatatggattagtctgcgtttgaactgaaaaggattgagtcgcagttcttgcagtgtatcttccgagtctagtattatgatgccaatgaagccttggaatcccaactctttttcgcagatggtcttgtattccaggccgttgatcatggttccgtcttccaagtggaaccatattccgtcgtctcctactgttatatttactaacgaatgtcgtgcgagggatacgcacttatcaatcttgatcacctttaggatagttcggacgtgtaaggtgttgaatacgtctgaggtttctaattcttttaattttttcaaggatttcattctccgggtttggggagaaaatgttcgaatcgaaaatcggctcgttgttttcggggtgcgtttgggttaaattatacacttctgagatctgatttagctctcggacgtatacgagtcttaaataatgcttgattttgctgctttcgtagatggctaataagatttcaccgagggatagaaagagaaattcctcgggaattgattcgaggttgtaaatatttaagagtcgccttaggaaaggcacgatgagcagctcgatgctatagttagagtatgtgatactttcttcctgtccttgattattaacgttttttcttaaccgaaaggttcgcatgtattccatttcccatagttggtctattcgtttgtcggcatattgtgtgtctgggatatactgtgaaaaaaaactgtttgcgactgatctggtgtcatctatggaaacgctagtgaatgggagcctttgaactatgtttagcgctcgcgataaagagagattctcgaggtcatggtccagatccgggttatagcgatcacaatcgttattcgtctcgagcaaagagtgtagatctttgattttcctttcgaacatttggtttgttgttttgagtgtttcgatttcatccatctgtgtttgtatctgctcctccatgcacttgatgatttgttttttgaacagatctcgaacgtctctctctcctgtgtcgatcgcagagcgttttcggaactgtcctcggttcagcatgagtttattttggtctattatagagggggtgatttcttgaataaatccttcaacgctgtccctaatgcctattttagatttgctgtccgacaagttgagtaaaaatttgattaaactttttttcgcgtcgctgtttttttcttctttttctatcatgtccattatctttttgttggttacatctgtctttgctgtggttagcacctttatgggaaatgtattcaataattggcacattttttgatgacgccgcagactattgtgtttttttagttctggagaaaggtgggcgaggggtgtagtcagcattaggcgatttctaataacatatggggtgctgtacgtgaaaaacgctatagccttcttgtttttaaagcaagaaatttgctccgaattccgatctcggaaaatcttaatattatgaaaatccggaatgatcacggaagatagacccaataaaatgggagtgacaatgttttgtttatgccgcactatgtcgtggattagtttagatgacacttgttgtagaagattgtataagttcggggccgtaggggtggttctcatgaacggaacgattcctacggtacagatccagtctacatatctgttatagtgactgttgtctatgctctgaaggataaaattaattatattagatatatctcccaagatcacctgtttaatcgcgtgagcccagacactaaaataatcttgaaatgacaattttttgttgtggaacggaaatgacctcacatgacgtttccattcatcgtggatttgttgaatagaaacgctgtttaaaagggcttgagctactccataggctatttgttttttcagtacggcagaatctcggagagcgttgtggattgtttgacctttgaaaaaatttttgtgtccgtgtagcatttcaataaaagtcattatctgctcagagggataaatcatgtctatctcttcgttgttcggaggtagatacgataataagtttttgcttaacatgtcttcggctcccaaaatagagttgattgtagataaggtggcttcgttatcagaaagacgcttggaggggcgtctgccagaagattggtttcgccacatcatggatcctgaaaccgagttcaacagcgaatttgctgatgctctgtgcatcggtattgatgaattcgctcaacctctgccttttttgccgtttaaggccttgttagtaaccggtacggccggggcagggaaaacgaacagcattcagaccttagcggccaacttagattgtatcgttactgcaacgacatctatcgccgctcagaatttgagcgttgttttaaacagaagtaaatccgcgcaagttaaaacaatttttaagacttttgggtttaatagttcacatgtatctatgagcgaacgtcaaagttatattgcaaatgacgagaggtcgattcaaattcaacaaaagcaagacctgtctatctattggaatgttatctccgacatagcggagagggcgttgggtgctgtcgcgtgcaaaactaaagagttacctgatttgtgtgagagtagtgttatagttatcgacgaggcaggcgtaatattacgacatattctgcacactgttgtttttttctattggttttataacgcgttgtataaaacccctttgtatgagaacggaattgttccgtgcatcgtgtgtgtggggtcgcccacgcagagtaacgctttggtgacttcatttaatccgctgactcaaaacaaggacgtgaagagaggaatagatgtactttcagccttgatctgcgacgacgtgctctctaaatattgcgaagtcgataataactggataatctttgtaaacaacaaaagatgtgcggatcatgcgttcggagattttttaaagcacatagaatttggcttgccgttaaagccggagcttatagagtatgtcgatcagtttgtgaagcccgcttcgtacataagaaatcccatgaacgaaatagaaacgacccgcttgtttttatcgcataacgaggtaaagaactatttccgttcattgcatgagcaggttgaagttaccaacagaaataacttgtttgtgtttccggtttattttctcataaaaaacaagactttcgaagactacaaaagtgaaattggtaatttctccttagaaattgaaccgtggtttaaatctaatattcatcggctgaatacttattctcagttcgcggatcaggatttatcgaaaactgttcaattggaggagattgttttggaagatgggtcggtggaagagactttgataacctgtcatctgaaacatatcagaaacagttcaataggtgtgacgtccaagatcaaggcttcgaccgtggggttttccggaacttatgaaaaatttgtagaactgttacagagcgatttgtttatcgaaaaaacgtcatgtgagcagactattcacgcatattcttttttatccggtcttatgttcggagggatgtattctttctgctgttcggaattcaccacccctgaagtgttaatggaaatcaaaaacataaagatgcccagtattgaattcttagaaagtgaaatgtcgaggatgtctcgagacgtgcaaaccgtagagacagatgaaaggtatgatttcggattagtcgatgatgggttatcagatatggacctattagaaattgatccttgcggagatccattttttactaggtatagtaagttgcctttaactaattctctgtcgttcgaggaaattagtttgctttatacgacgtttaaggatatctttatatctaggtttgccattctgcagatgcatacaaaagggaagttcggaaagactctcctagtgacttataacagaaacaacgtttctagaaaacagtgcggtgagatatattcccatttaaagagtttttatggtatgctcacctacgctatccctgccaataattatactctggagggttatacaaatgataatgtagttcatttaggaacggataaacaattaccgcagatcttatataaaaaaggattacctagattagttataaaagatgaaatggggttcatttctgttttagataataacgtgtcgaaatttgtcgatgtcgtaaatggtcagagttttcatctatgtacaacggtcgattacgccactgtttctaaagtttctatgaccatcacgaaaagtcaagggctttccatacaaaaggtcgcaatagatttcgggagtgatccaaaaaatttaaaattgagttctatttatgttgggatgtcacgagtaaccgacccgaataatttaataatgaatgttaatcctttgagactgaattatgagaatgataattttattgctccgcatattgtaaaagcgttaaagaacgaaaataccatgttaatattttagggaggttttttatgagaatatataaaaaaaactaaaacatcagatgaattgtgcgtgtaattgttgaaattccatacggtcgaatgagcttatttccgtcggtccgttttttctgcaaaacaaaagtagtacagggatttagtacagtatgtctcgaaaaagacaagggtgtgaaactttatgaggaactgatgagaaatgacttacggccatgattttgtttcgtcgctaaattgaatacagctgcagggatgtggtatgagatgacatctgcaaaaacaaatgaaagtctcccccggagtacacgtatgtactccgggggaaacctcaaaaatgcacaatttagcctattaagcagccgcgaactcgttaatagttactttgatgttaactcaggtggtggcttggatggtgtcctaagtatcaatcgaagctcctttattttttgcactactgaagttattctaggtatcggggtaagaataagatgacgaaaaaaatatgctagatccgtccattaaatcctagagttgtttttagtaataataggttatttacaaaagcctgcatatgatccaatgtttctgtatgaatccagataaacaaaaatccaggagtaatgattggaatcacaaaatgattagttagatgcttaacttacttaataactacacttatagactaaacttaacttatcaactatacttaacttttaggtccttataatgtgaactaaataatcaactgttttgtgcccaatcccccactactaaagcaatcgtctttgatttatgaaacaacgaggcccacttcacgttattacatagatcaaggtctatctcttggcggtttttgaattcttccgagagcgtagcggtttctaggtttcagacacgtttatccattcgccgggtattgatcgggtcatatcattagccgtgaataatctctggcttcatttcgatacaacgtgtgaaaactagtaaaaaggacaaaagcagccgcctttgccgtcttcatgagcgtcaaacactcatgaggtccgtatcttacaacacaatatatgaaatactgtgagcgaggttaccggtgtccgagtcgcaatccgaaaatcatatattgaaatttgtaacaatgttatgcagttgtactcaaagtatatggtgatgaattgaacatgtttttgatgttttcaatggtattcgaaaaatattttagatatcctgtagtttttttctgatgacttttctgatgacttttctgatgacaatatagaagatggcaaaacaacaagttactggtagttcttgatgttagataaaatgaatcggagatatgacaagtagagagaggtaggtgatacgagtaaaattgaagggtgtttccacacagacgggggaaattctatgagaaccacagccagaagcaattgacgacaatagagaaaataagcaagcatactcatctcgtatagaaagaaccagtgacctacgattttccattcaggctagcatggtgtgaacgagggttttttccgaaaactagatgactatttctttaagcaagtgtaatttttagcagtccaagtttttatgcaacgcagattttaatgatgtgtccctcgataactatacgctggaaactaaactaacttacatcttggttgataaacgattttctattaaaaagactaaaggggtttttttggcatatacaaaattgtattgagctcttggaagtgcgtagatgcaaaataggttaaatcttaccttgaagctacaacaggtcaacgttcgagtagacgtaagttccatatgtcgaatgcgctgtaaactttttcacggaacatcaaaaacaccgaatttattcacgtttacataagcatgaatctgcaattttaatagtcccataaagctttcatttcgatctaactacattttagtatttatgctccataatgtatcaaagtgtatacattcaatctgtataagagtctgcatcaagcttcacgtgatttgtagttcgcggtttagcattcgctgttttgccgtgtatgagacttacagtttgatccctaatacttctgacgggcgacaagcctttttatatgcattttacggtaaagtccacgcccttgtcgctgacgcaatacgtaaaggttttcggtttggatgaggatgtggttaaccgttagtaaaaagtcgttacagtaaaaaagccgaacggtatttttagatgtcggaccacatatcggtttaatagatttttatatcgtgttcgttgtctgacttagatatgtcgtttcatgggagaaataaatcgttttagttgtgtgctgtagtttttggatcgcaaacgctcgagcccggaagtgtgattcgtgcgcataaaagggcgctggtgtctgtgctcgctagctcatttgtgctggatgagcggcaaagaactcatctttctgagatttttctgggattcttttggtaaaaatgtatgtctcgtttgtagtcgtttctggatttctgtaatgttacgatttgctatgtgtattttgatggtgtcgagcatgtttattttgttcttattttcacacagataagatgtatgctgaagaacgtggatatgggtcatttgacaatgttatacaggcttatgaacaaattattagtcagtctcttcatttgaaaaggtttgaattcgacaatggctgtttcattgagttcttagctgactctggaacgtgtgaaacgttttctaaaggatggatatcaatgatttattggacatcggagacagattcaatgggttctctaacggtggatattgggatggatgaaggaaaatgcagaacgtacagagctcggggccttttactgtgttcaaaatcaatcacgtcgatttctcagaatactgagggcagagagaggattttgactgtttcccatgaaaacggaaaacttcaaataacgtttgttactattgctaaagtttcctcggagcccgagctacgaaatctgggcgatttgaaatttatggaaaagtttgaaaaagaatgtcgagctctagacaggaaaaaacacgacgatgaacacagaaaacgctcggggaagcagaaagaaaaaagaaaagtggaggacattgacaaaaaaaaagaagatgagaaactaaaacaagaagaaaaaaaacgaaacgacgaagacaagcggccggacaaaaaggatgaatttgatggtaaatatgaatgtgtagctgttgtaaatttttttattattggtgtgtcacggtcgtggacttttttaaatagtatctgttttgttgtgatttcagaaccccctaaggagaagagacagaaatctcaccacgaaacgaaacgtaatttggaagaacaaagtcacgaagatggcatagcaccgacttctacgacattcgtgaatggagcggttgagggtgcgttatcgccctgtgtttctattgataatcacgaagatcaacaacatgatgaattagacaagcgcgtttatgcgcaggtgggtggagttttgggttcaccaaaacctaggtctttggagtctttgttgtgcgtatctaaagctgatctttttcttttaggggacgaaccgagaaggtctatccaatgaagataattatggaaattttcagcttaataagtctttagaacagcttagggccagacttgttgcaagcagcggcgaggttgtagaaagatcgctttcgaaattgaaagagcgtttggattatgtaaaggataatttaataaaaaatgtacttgaatgtgctgatgttactgttccaagtaaatgtttaagtaaaacaaaacatatcgagcaaaagaaacagatagtgttttctgattgtgtcaggtcggtacctgtgtgtgagattaaaccgtttatcgacatgcgagtatttgaaactgaaacaacgcagaacgcaagaagagttcgacaacggaccagaacaaccgtcggatcaacagatggtgcaatcgggcagcagcgtgttatttcaggacaaaaccggggcagagcacgaggacgtggccgagggagagttcccaggagacggaattccaatctaaataatttaaggacacaaaattctgcaattgtcatagacgatagcagcgaaaccgaaaactttgaaaatgctgggagttttaatgaagacttactggcaaccacaatattggaaacactgtgaattttattgctgtattgtaattcttatgtaaactaaataggttctattcgttcagaatgttccaattgattgggtctttcccgtgctcagtaagaaataaatttgttcgcacaaaatgattgcaaccaataaatggcattcttgcagctttcactttgggtgatggatgtgcactttctaagacgagatgtttctgtgcgtctattagataagagagtttccgggcatgttttccccacaacaagaaaacgagagagttcatttgttccgatagtctgctgataatcttgtagctcagtgtttgccaaccaaatgcctcgtgggacattggtaatccatgaactacagtgaatatcgagtttagcagtaggactccttctctacaccaggagtttaaacagccgttgtcagggggggaaaaattcgggatgcttctttccagttctttaaatatattctttagagattctggaatcgagcactctttcactgtaccgaaggccaaaccgcaacctctgccgtcgggatacggatcgtgtcccagaatcacaactttaacatcggtgggtttgcacaaaaaactccaggcgtggacgttatccgaagaggggtggacggttagatgagctctatcgttgtccaccaatttataaacatgcttaagatgtgtaatttctaacttggagagttgcaggaaactcaaccagtctctgtttatgccgaagagtgaatgctgatcatctattgaaaggttttcatagtttttttcttcatcctgaacgtgatctaacatccactgtagtagggccatggttgggaaatgaaatgcagtggattaaattccctaggagcattttatgtgaatgggacgtgatgtcatagccaattatgtgtttctaatcagaatcgtagggcgggaacttcggaaaggtagtttagaattgtaggcttccatctgttttagcaggtcgaattctactccggttttcaagtggaaatactttaaacaattcaaaatcgtatcaaagagagtcaaagagttaaaagggaacctgataatttttgtgatgcctgtagcaggattctccaagtataataaaaaaccaatgttgctgtaaaaactgtctgtgttttctgaaatgttaaactcgagacctgcaatgttatcaacaaaaaagttattgacgtacgtaattctttcaggcaaatattttctacagttatcgctgatgcaggttgttattccgacggaaggcgaacatgtctggaagccattgaaaaagtttagccaattgtcccgagattctgggtcccctatcagcgcaaacaatgtgcgtagttgctctgggttatcctgcagaagtaagaagtcgctgaggaattcattggttaccattatacggctaaaaggctttttttttgttgggggttttagcagtattgacataacgtcttcattatataccggagcttggtagattggttctagtaatagaggtacttcggatctcgtgcaatttattacagctgcgatacagtcgtcaagtttttcaaaatagaaagaattgtggtcgaaaagaggcatcgctttcgagaaggttagtaatatgagtgacattacaaatagtaaaagttccatggttattttttatttggagaagttaacacgacgggaacaacatcttatatacagtagggaaaaagacttgtcgaaatgttcatttggctttttattgtttttttttatgcggcatatattggtatggctatcggatttatcggtagttcccccgatgcggagctgtcttcagaaaattcacgtatttcgtcttctgtcttattaggatgtttgttgtgttgcacagattggtccgctgtcgtacctgggaagacagagactttcagaaaaccttttgttgcaatcatgattaaaaagctaaaaagttgttttgctgcttacctgtctgatttagagcagggctcgatgtgtgatatggcaaacgcatcgccgacaagtcttgaattaggattgtcgaaattagacaaagaatcatgaaactattcgaagacattaatactggttttctttctcgttatgacgatcaatatagaggacgcaaagagagaccaatttagattcgagccaaaaaagtttattttgtcagtttaatagtttgccataatcatcccaataaatatatttgttgaaagagttgtatatggtgatgtgttctcgaaggagcatcggttgtgttacgttcgcgatattcagagtaatctcgttgggatggcagattgcaaaattgatacaaacgtgagcggcgcataataaatctttttccgtcggcgcgtttatcatgagagagcaaatgccgacaagctttttttttgaggcgtttaccggtataggagctacagcgttttttcgaagtgcgtccgtatgtgggacggtccctctaaaaaactgattgattgcaatagcgactaccggttcatggtgaaccgattcagaaattatttgctcgcccacgttaataaccatgttgccaatggacatcaatttttcttgcatggcgtttattaagattttatttcgggaataaacctgtatttgcacaattgaagcgttgtaacagcggaataatctgtaaatttctgacataaaatttttaggtgagcacggggagtaaggtggagatgtttcgtaagattgaaaaattttgaaagcgttgactgcattcggatcttgcctttggcattccgtagacttgacaatttcctttttctccgtcgttgatgtctttacaggcatgttgaatgataggtcggcgagaggtttgtccgtaaatgcagaaaaacgattaatttctttattttggtgaaacacggcgtttgagattttccgtagtttggaatgggcgtagattgcgttatttcgatatttttccttattaaattttatgtcgggcgaggtgtgctggggaaaggctcttgcagtggcagaatcgacgggtttatcggtttggacggtttgcgaagatagattgttttgtaatcgattatttcgtatagtcgttttagtggttagattttttttccgttctgtagacggtttcgttgtttttctagttcggcgagatttgacggtctgtcttgttttagaggtgtttttattacctctgtctttcatctcttctgaacttaagccatataaattttaacttttaaatgcaacgatacacatcgaaatcagtagcaccataactgatattatcaatatcagaattaatggtacgatccaggtaaatacggtttcgtcagaatttgagccttttaccgcttctttactgtattcgtcgtgattttgcacagtgtgttcgccggaagttacgagagcgctacgcttttggttggtaaaccagctcgacgctagacatgagatggtttttccgacaaattccagcttggttcgtcttttgaaagtaaagctcacactaacggttgacgatccgttttcattctgtctaaccattggtatgtctctcttatatacttctccaagaaatttaataaccacatttggttttggataagacgtcacggtacacgtaacgtctaaaaaattgtttaggtaacgaaaatacaaaacgacgatgggtttcataatgagttttaagcaactagtcgcagatgttttctcgttatccactgtgaatgtacaggttaaacatgtcgcgtcatatgctgatctggctttaattttcaacagagatgtagttctatcgtgttttatgtggaaatacaatttactgtccacgtcaagattgttgatcttatttagttcgtgtataaagacgtagccatcgtcagtgcccgataagttgtccatgttttgtacctcatgattcgatataagtcggcttttattgtaccacgagacgctttggatgtttgtcgttgtgttgaggcgacaatggaaagtaacagttgaccctatttcgtatactaaagaaggactcgtctccgggcggggtacaaaatgtgcgcttatgataatacatagaagcggcaataatcgaagcatcaagggactcatagtgtacacctgtgccaaatagcagtttctgcgccaaatagcggtttcggatatatataagtcacacccaaaataaaaaaaagtcaaggatttccgttatactgttttatttttttatttaaaaaaaaagttgggagttaacattttgaaagtgtaagatatttcgatttaaaatctctgctgacagaattatagatagagatagaattgtcaccatcaatgattgagcagacccgaaggacaatttctttaggtttatctttggcatacttattgcatattttagaagccattacaaagtcgatgggcgtagcggcgtaaaccataagagtttttacgtccgaatgtctcgtaaatagatcatgtgtgttgttttcaagtttatcccacaattcttgaggtccttgtttttgtagttctataaattgattaattgcatctttgtcataatagttaggcggtgcatgattcatcttaaatggctctgaaacagtgatgttgggtcgaatcattaattctctttgcatcgtcttaatgatttctgctacttgttttgatcttgtaaagtacataatgatggctccggtgttagagcatccattagaacagatgttgtatacagcttcttttagcttgttttcagggaaaggttttttggggatctgtttgtattcaaatgctcgtatggtatttctaaagagttttctaaaatcttttgtagacaccctgccgcgatgaattttaaattttgccgattcttttttttcttttcgtctaacatattctctataagacaactcttcttcaatttcacttatttcagaatctgttttcttcgttccagatattcttttcttgaagaaattttgcatactggaatctgaatcatcatcccgggtgcgcttttttttgcattttgttgtgttgcgtgatatgttactttggttatcccgtgggcgataaattgtgttagtggtggtgttcgtggtcttaggtgtctttttttgttcttgatcaatggcgttttctaaatgattggattgttcatgtgtgttagatggactagaattgtctaggggaaatttttcacctgttttctgggagtttctaaacatatctgcatgtctatgttttgattcgtgatttggagatttgattttggttttgtctcttgaagctgatttaggtcttgtttgtttttctagttgttgtagtctagatctaggtgaatatgtggcaggatcttcactgtttttatatcgacttttgcgccaggattttgatctggaactggaacatgatgaagagactgatgatgatgatgccgatgatgatctagttctggagtgctgatagttaaatgttataagcttgtctgttccggtttctgtacgtgaattagatctggaattttcttcaatactggaagagatgcttgatgatccagatttgtgtttttttctttttggagtattgagtgaatctggtgaataacgagagtaagatctggatctagatgtagaactttctgaatcggtgtaattggtggattctgatttttttctgttggttcttatatgaggtctgaatcgggggttgtaaaattgatcattgtggttaaaggactggagtcgagctgcagtatttttgtagaaattgagttcaggcccgaaccgaaatttgatttctgatacttcagcttctgtactaattgaggtgtcatgtggatatatttgtcttttattagaatcgcaacaaatttgcctcggtttacgtttgtttgaagttttttcacaagtttgaggggaaggtatgttggacattaatttattgttaggggttttaccggagctctgctggaggccctgctggaggccctgctggaggccctgctggaagccctgctggaagccctgctggaggctctgctggaagccctgccggagcctgctggaggctctgctggaggctctgctggaggctctgctggaggccctgctggaggccctgctggaggctctgctggaggctctgctggaggctctgctggaggccctgctggaggctctgctggaagctctgctggaggccctgctggaggctctgctggaagctctgctggaggctctgctggaggccctgctggaggctcttctggaggccctgctggaagctttgctagagactccgctggaagctttgctggaagccctaccggacgccctgctggaggctctgctggaggccctgctggaggccctgctggaggccctgctggaggccctgctggaggctctgctggaggctctgctggaggctctgctggaggccttgctgaaggctctgctggaggccctgctggaggtcttgctggaggctctgctggaggctctgctggaggctctgctggaggctctgctggaggctctgctggaggctctgctggaggctctgtcagagacctcggtgaaagttttactcagaggtttatcagagttttcgccattagtttggttagaagtttcagatttattttcggtggaactgcagttaggtttcatgtcagtacattcatcaccgttagaagtgctattcatggtgctgttgccactgttggatttgttaaaagcagtaaatgagctaggattggaatgactccgaataggtgaattgtctgttaaatttttgttggcgcctgcagagtgttttttagacgcacagtttctgttcatagttgaaggagtttcttgcgtggggcatgcagaagttgatggaataatagtttcattacaaaatagttgtgaaaatggctgaataatattagagtcctctatttctgttttatttgtattttcattggaaaaactgtttaagtccgtattttcggtactttcttctgttttatggtttgttttgctgttgggggttgttttagtgaaattatcatagaatttatctgataaacaatttccataattgctttcactgttgttgggggatttgtattggccttcttcagagctactggaatcatgtatacaatggtgcgtttttgattttggtggtgtagatatcttttcattgtcgggtgaggttttatattgttcatcagatgttttgccgtgtaggttatgtgagggatcagacttttttgatgtatttttggcggctttccctgaaacatttttaacgactacttccctaacgtcttggtgtccgttggagtttgcagtattttttttagatgtcgtacgtccccgagaatgtttcattttaggatcattagtgtcttttgggtcatgatgttttttgtaagagttatctttggtcggggctcttggagcatgttttgatatgagaactctgtcttgtagagaagtttttgatcggtgtatatttttttttgtgtggtggagttccgagttagaatgaattttagttttatgaaccgcaaagtttaaggtgggctcaggtgtcatcggaagaggagatagcaggggatctaattttgaaaaatccctagcttcagtaacggcttcatcttcatgctgattagattttctctgtttaagatcagaacgcgatggaacatggttttcattatgtttttgtactttatgtttgtttattgtttgagaactgtgtccttttgtcttttggattgatctacaacggatatgtgtttttttgtacttctgagtatccacgccacaatttgagccattgtctattagtgcttccttcggtaacgggataacttcagtgtcatatatttttttaatgagatccattttttgggaactaggtctgtatgataaactgattgcgtcaggagacgttgaaacttgctgttttttgtgttctttgttatccttagcattctcatgttctttagttttcgtagtttctggtgttgtctgtgattttgttggataattgtgattgtcagattgtacgtatgtggggtctgttgttattgaagtttgtgaaaatgccatgctatagtcttgggcttgaaaattgaagttggttgttagttgtgtaacatctttatagttattcatacggagatctggattatattgttcatagtttggatgcatgtattgttgatatgataaatctgcggatctgtttgagaaatcgtgtagtctgtggcctcttccgcgtctgttataacttctgggaaaaaatcttccatatggctgttgatactttgagtttggattgaagtaattacgactatcgtattttccctttcctcctctgggtctatgggaatgatgtctaaagttagagtcatatcctctatcggtatttctagattctctgtaggaactctctatactcctgtatgcatcataattaggttgatacggcaacgaggtgaaattgcactgtgaatttgtagtttggttctgtgatgcgtacatgggctgtaggacttgatctggcagttcggaagcaaaacgcatatggatcgaattgtttccgtttgatggtagattggaagcagaggatgtgcattgtctgtggatctgagctgctctccgtggatcctggggagttcttgaattttttctggaatcttgagaagatatgggatcttgatgcgtattctcactcaatggttgtctatgtgtgacgtccgcatcatggtatagtccggataatttcatggcttggtggacaacgtcgttatgagcatttgcttgtttggatttttgttctggaaaacatgtttataaaattcaagcttaatagatagtatttttccgtcgattagtgatacgcttaatgtatttaataaattatggataatcattttgattatgatacatcccgtgcagagaatgatgtttatacagattgtgcgtagtatgcaaatgaaagttattccatcgttttgtaatatgaaaagtttcaaatatagtaaagaaaagtacatatacgttttcaaggtgtgttctaataaaatgatgaataaaatagtagttttctatagaacgtattatagacttttattgcataataatcattgagtaaatacgtggagacattaaatttgtattttgttttttagattgttgagctatatagataaatttggatgataaagacgttatagtttgtagtgaaattcactaaatcgttttaagcttttatatttatcaattaagtagtaactttccgtggaaatgtcgcagaagcggaataatgcatttactaattggaaaagatgtaggagagtggtaaaagcctattggtttcttaaggatgtatatcgtgcgatgtgttattaactagttagatgtggattactaataatggggggggggaattattcgcataacatgcaattaaaattcaattcaaaatttatgaaattgacattatttggagaaattttatgggacgcatgatttatataattgatctattaacaggccaagcgacgggatttagtgagcatgatattaaatcttttcattcagtagttgaagttattttcgtggttgattacatttttgaataattaatggtatataattaataataagtagggctaatagtacaatttattatcactattcttatgcgatgagttcaagttcgggcgctgaaaaattacgtgtaatgaacactttttttagagaacttatgttattagagaatttatgttaattagtagttcaataatagaatttatgatttatcaatcacgtgatatgccatatatttggaaatcgcgtgtaatagtatattaggtgtcatatattaatttcatttaaaactaggatgatcattaacataaattatatataatacctgatgaagttaatggcaattgaattggatggtatattaatttatatttacttatttgcattagattatattataataaaattgttttaatgttaaaaatttaaattattgatgcattcattattgacgtgcagtaaatccagtataatgggtaaaagtgagatttattgaagggggggggggaaatgtataatatccatgtttttaagatatggtaatatttatcaattatctaattgtctaattctgttggttgtctacagggaacctatagatatattcaggaataattggagttgaaattgctgaagtttgtgactaccaaagggttaatatgcataatcaaatagatactgatgctaccgtggggatggatatgatttgataattagaatacaattatatattatttattatgtattatggagatgacataatttaatataatacaatatatgataatttaaagtttatagtagactagttttattatgtttctaatgtgatagcgccctccgctgttcaggtaaattatatgatattgaatgttttgagtagaatagtttgattatgtttatgatgtgatagcgccctccgctgttcaggtaaattatatgatattgaaagttttgagtagactagttcgattatgtttctgttgtgatagcgcccttcgctgttcaagtaaattatatgatattgaaagttttgagttgactagtttgattatgtttctgatgtgatagcgccctccgctgttgaggtaaattatatgatattgaaagttttgaatagactagtttgattatgtttctgatgtgatagcgccctccgctgttcaggtcaaaatttaagggtggtaaatagacatttttaaaatattttaaacctaaataatttcatctattgtgctttttgttaagatgctgagtttgtgtgtttgtgtgtgttgtgtttgtgtgtgttgtgtttgtgtgttgtgtttgtgtgttgtgtttgtgtgttgtgtttgtgtgtgtgagagagaaagagatagagagagatagatatatggggggggggggggaatatataaatatagtaattttgaatctgtgtttccaaaattgggaattatgcgtagcatcccactttcaaagtgatttcagttaataagatgttggattaaagatggatttggtattttagatttatactttcaagtgtttggtggaaaacagatagaacaatggaacgttgtctctgaaaaaaaaaactagtagtgtgacatttaggaaatgtggtttggatactttcatcgtgtaaaaagtcaaaaggttgaaaatgttttttttttttttcatgaataggagctattatgtgaatgttgaacaaaaacagattaaatagacctgaaaggataatattgtgtagagtgctacggtctagctacaactaatgtaatacattttttagcagtactatgatttataaaattaagatgtccccggggcattagtcttaataaactggtttagtttggaaaagagaaagtgaaaatctgaatacttggcatctgtataaggttttccaagaatacaattgtttatagtatcacatcttcaagaaagctggaattaacttatggaaatattgtatgatgacttataagtcagtttatgtacatgacttggaattaaaaagagaaagcaatgtctgtatgactttttattatttgtaaggtgatattgaaaataaattcctttgagaaatcacatgtttgctgaggttttacataatagaaaaagttacatttgcttatgtaatttctaatctatagcaacataaagagttacacagtatgggaaaagtatgtattttacaacaatataagcatatttacataatacacatctgtatgctaatgattgctaatcaatttacatcttggtttcatctagctaataaatttgagcattttcttcgaatggatcataatcagagggatagccatctaatttaaagacttccattttatcactgttgcaatcacttctaatggtacatttttcattatcattacttgtaccttccatacatctgttctcatcattgtgacatgttgtgtcattgataatatttagtatgggggagttatttcctgttccctgcgggtcaaatatttgagtttcggctgttacaagactttgggaatttgtcacatttaaatttttctcacatgcagtagaggtgataacagtatatttactggaaagatcttggcaatgtttgtctatgccgtgtttaatgatatcagttagatccataaaattttccatgaccatttctgtgataagtttcttggttggtgttatgactcccaagtctgttttgctatcctgtattttactataagtatatgagacattatccttattatattcttcatcatccattttaatggggacaaagtgattgatgaagcagtgattggcttctgtcccatcactgtcattttttacattcatttttgcagaactgtgtataacacaattgtctactttgtgagttttcctcagaaaccacaaccaattttttttgggaacaaatttgtttctgatatcatgggtacccggcattgaccttattgggatggtaaacactggggatacaaaacctttacttttacaatgaccattattgatcactttatcataatcactcaaatgtaagtaattatcttcagatgtacagtcatctgactcgctgctcgattcagaattaggttctgatttaatagttttttttaagattgagctatcaatattattgttaccatcctcttcatcttcactctctgaacttataacaattacgtttgtggtttcaggtaacttatctatcttaatctttttagatttggatggtttaattggaacatttttccttttagctgtcctctttttagatttgcatttctgagtcacaggcacaattttctcagttttgtcattttccttagaaggagtgacctctggtggtgaatatagagacttgctaaatggtgtattctcattagtgttattcatatgaatgttattagttctgacagttgaatcacagtctgcaatgtaatcagtttcatcattgttatcgctttcactctcataaggtgctgagtgatcagtttcataaccaaatgttatcatttctgatattaaagggttgtcatggaaaccatcacatagattcactagactttctacagctcccaattctttgtctattttactttctggatttaaagtatcctgaattgcatcatgacttttgacaggagttgctgagtcggtaaaggtcatacaaggaagcgtttcggtacacttggagttagaacctttttcctgaatcctttcttttgtctgtgacctttgatcggggctgtaagccaaaatgtcttgttgttcagacccggtctctacaactactgagtcgggttgagtttcaagtagtttttctatcaagacgtgtttacaactttcaaggccagtaatggatttaaagttattagggccgcccagatctgtcactgaggctgtacatacacagttagggcttgtttgttttttccctatctgtctgctattttcaatgaatgtttttgcctctttggatttccctggcacatctggagaaggagtatctggatacattttttctacatctttttcatgtatgtttgtaagtttttgtctagttggggattcattgttctttgatggggtgggagtattattatcagtaggagattgtacttccatgtattttaaatattctacattgtcatcatcttcatggatagattcgatagaagattcctctgaatattttccatgttcatcaaattcagctaactctaatagtattgattctgaagggtctatgtttaaatcacagatggaagactctctatctttatttatagcaatgtagccttccattatatcagaggaagttaaaggtttaatcaaaccagtatcatcataaactgtttctaagtattcacatgcgtgggtgatcatattcattatggtaattttaaactggtgtctgtgaggtttgaggtattgccatgaaaattcactgctgcatagaacaatactttggagaacagcagtgctaatatttttggcggcagtaattaaatttttacaattcacatgaattttaaggaatgttctatcacagttatccataaagatttgattcatctgcttattagcaaattcctgaaacattttcatatttttaacatggttttctattatctcatttctactttccagtagttcctgtttaagtaaatttactcgcccacaaaaatccttattggagatgtcaggattggacatctctttgttgtgtgccatcaacaacaatgaggtggaaaccatgttcaatttttcacaatctaatgccacataagctttggaaaaaatgtttttgatggctataacaaattgattgttcatattagctttcaaatccatgagcaaatctctggattctgatgccatctttttcactaacccatcaaatttatcacatgcaaaaacaatgaatcgcggttcgcaccaattaaaaaaatccaagttttttccagataacatttttgcataacttgaaacaaatttagatgaaacactacttagtaaattaatatttatcaactgtcctaattgttctaataccagcccctccaacatggatctgtgcagcgttaataagccagcggagttaattaaatcgtcttccatgttagacagttcctgtttcatggcagccttcactgatgcaccaatactttggatgcaagtgccaacggactgagctaggatgtaaaagaagatattctaagtatgctatatgttacatgcttaaaactatgtttttttcttgttttctatcttgggacatataatatataattcatgtactcaccaaccaaagttttgaattcttcagatgctccttcttccacattactggaataggacacattcttggaagcgatgtcgttggaagactctgggatgaaaagatcaaaggcttccagttctggaaaaagcaggctttcaaaggacacatcacacttgagactctcttccaatatttctttgatggattcttccaccactggatcgggatggtagctgtaagtatggatatttcttagtacttagaaaaactcccatatagttttaaataagatagatctaataaggactaatcatacttacttttgcatacgttcctcattggattccatgttgtttccagagggttttccgagaatgaacatagaagtaggggttgtatcttttgctgactccattgtatattaagatgcaaattcagacaccgcctactgttctgttagccaatgaaaaaatatcttctgtcagcagatataatactatataaggagattaccaccacctctttctttgcagagattattctctgcttgaaaatctgtaacactgatcatgatgggatatgaagaaaaagtgtcagctactggaaagactcgtttaaagatactggcatgtctgatcgttttaatactagctgcggcaataactatgttaacgctggaaattatatcgaaccaaaaacgtaccactactgatctcgaagctgtgactgtggcgctgaagcatgtaagcacatctcttgccagctgcactgaatccactacttctgtacataccggttagtgaaagatatgtcttttttatgttaatgtattgattatatatttgcatacattccttaagaatggaaaaatcacggatggtttgtttttagattctgtgacgagccaacccacgaaaaacaaagaatcgaggaaaaaaattgaagggaaatctccaagttgggttcaggctttaactacagcatctggaattatcctactgttttgtataatgatgatattcattacatgttcctggaccacagaaaaagatacagagaagagtgaagtgcaatcttatgcttcttcagtagagactttagactctttaaatgaggctattataccgaaaactgaaatgaatgtgtaatgtctgtatttttctttacagagatgtacggagagtttatatttggggaaaatacctgactgttctgcctatatgcgaatgttaaagtatgtataatataaattcttaccttttaagagtgattcaaggtggaggtttctttggagattgattccaggtggtggtttcgggtgcaatcaatctttcttctgggcgggaagaaaatccagcaatccaataattgatgggatgtaatcaatgtcacaaatctgtaagattaaatgtgaacagtataaattctttcgtgcttatcaaattacaattatgcgcatgaaaatatcattaaattgttttaaacattcttaaattcaatttaaaataatttttgtagcaattttaaatattaatagttaaaaaattgacttaccagactgcagcgatataagaaagaatctctgtgatgagaatgttctccggagccacttcttgagaaaagtggcactgaactggctgtaacttctgcttatatacaattctatagcgggtgtgatgtacaggaaaatgacgaggatgaaggagccaatcgctgtataatgttaaaccgcaagtgtagaaatacaccccttttagacaaatatggaatggaaattagctgatgcttacaaaaatttagggttttgtcatatcttactcaaaaacaggaatttgtggtctggattttttgaggttttcttcttatggctgacttgtatttttttatgagaaagacggagtttgcggttgaaggcgggataataaagaacactttactgataaattgtcatgttttttttttaaaaacatctgctacacatcatgaaacaggaatgtggttttggtgttagcgcttctcacgaaataaatgacttagtcaggggaaaatgttgtaaccgcggtacacactgacctttaactttatgagaaaaacaggaactgcggttgctctgttagcagattttagggttctcgttagcctgggtaggaaagaccccaaccacagtacccactaacctttaacttaatgagaaaaacaggaactcggttgcttcgttagcagtttttagagttttaattcgcatgaacaggaaagacttcaaccgcaatatctgctaatttttaactttataagaaaaacaggaactgcggttgccgcgttacgagcttttagagttctcattcgcctgggcaggaaatacttcaaccgcggtacccgctgatctttaaatttatgagaaaaacaggaactgcgattgccgcgttacgagcttttagagttctcattcgcctggacaggaaatacttcaaccgcggtacccgctgatctttaactttatgggaaaaacaggaactcggttgccgcgttacgagcttttagagttctcattcgcctgggcaggaaatacttcaaccgcggtacccgctgatctttaactttatgagaaaaacaggaactgcggttgccgcgttacgagattttgaagttctcatccttattagcaggaaagatttcaaccgcggtacccactaacctttaattttatgagaaaaactggaactgcggttgctccgttagcagattttagggttctcgttagcctaggtaggaaagaccccaaccgcggtacccactgatctttaactttatgagaaaaacagaaattgcggtttcccccattagcagattttgaagttctcatccttattagcaggaaagatttcaaccgcggtacccactaacctttaactttatgagaaaaacaggaactgcggttgctccgttagcaggttttagggttctcgttagcctgggtaggaaagaccccaaccgcagtacccactaacctttaactttatgagaaaaacaggaactcggttgctccgttagcaggttttagggttctcgttagcctgggtaagaaagaccccaaccgcagtacccactaacctttaactttatgagaaaaacaggaactgcggttgctccgttagcaggttttagggttctcgttagcctgggtaagaaagaccccaaccgcagtacccactaacctttaactttatgagaaaaacaggaactgcggttgctccgttagcaggttttagagttttaattcgcataatcaggaaagacttcaaccgcggtacccactaacctttaactttatgagaaaaacaggaattgcggttgctccgttagcagattttagggttctcgttagcctgggtaggaaagaccccaaccgcagtacccactaacctttaactttatgagaaaaacagaaactgcggttgctccgttagcagcttttagagttttaattcgcatgaacaggaaagacttcaaccgcggtacccgctgatctttaactttctgagaaaaacaggaactgcggttgccgcgttacgagacttttgaagttctcatccttattagcaggaaagatttaaaccgcagtacccactaacctttaagtttatgaggaaaaacaggaactgcggttgctttgttagcatcttttagagttctcattcgtattggcaggaaatacttcaaccgcggtacccactgatctttaactttatgaagaaaaacaggaactttgttgctttgttagcagattttaaagttctcatcctcattatcaggaaagacttcaaccgcagttcccactgacctttaagtttatgaggaaaaacaggaaatgcggttgctttgttaacagcttttagagttctcatccgtatgggcaaaaaaaatttcaaccgcggtacccactgatctttagctttatcagaaaaaacagaaactgcggttgccccattagcggattttagggtcctcacccacttgagtaggaaagaccctaaccgcggcacccactgacctttaactgtatgaagagaaacagaaactgcggttgcccagttagcaatttttaaggttctcacccgcttgggtaggaaagaccctaaccgcggcacccactgacctttaactttatgaggagaaacagaaactgcggttgccccgttagtaatttttaaggttctcacccgcttgggtaggaaagaccctaaccgcggcacccactgacctttaactttttgatgaaaaacagaagctgcggttgccccgttagcaatttttaaggttctcacccgcttgggtaggaaagaccctaaccgcggcacccactgacctttaactttttgatgaaaaacagaagctgcggttgccccgttagcaatttttaaggttctcacccgcttgggtaggaaagaccctaaccgcggcacccactgacatttaaatttatggaaaaacaaacttttttgttcatcatgcacttttttatatatcattatatctctatccaatcagcactcttgagggtgcatacattaaggcagtgttgattttttttcattgtacccacttacgaataacgaatcaaaagccgtgaagtagaatattttaatgatgtattaatcatcatttcctaccacgcctattaacttcagtatttataggataggcaatttgccgctatacgccattagctgttcttctgctagcttggacacagcggtacagggtgagttatcagcgtcttataatgtgatgtctttttttttattttcttgtcggtattttaaaagtagtctgttaagatgtttttaaatagatagttataaaatttttggaaccgtgtagtcaataaaacaatttatagaacggtttctggcccagaacagaaattgatttatgtcgtctttctgaattacaggaaaattgcgagggataactttatcaaatgtaaaattatataccctctgtgatagatttattttgtggatatttgaatgtaccatcgagcgtatatcaacgcaagatgtggctatgatgggacacggtcctatctgtacgtggtcgttttcattaattgggaatattattttttgacccccaaggagggattttataatattaaaattttcaaagttgatacttatgtctttccaccacaagactaaaacctgtccgtaagctcttaaatttttagtattcaaagatccgtgtaatattccatgtaacgggatattttcaagaatggctcccgttaacatcgattttccacatccgggtggaccaataaaactaacggtgttttttttccctcttctgtggcttagccactgatataatatggttcctgctaatatagggtcaaaagactgcagacagaacaactggtaaaccgggttttcatagatttcaaagtcagtgtctatgtgcgctataaaatcgatagcttttctagttgctcttattctttttttagatatagatagagccctatggattagcacgtccccgtgtgttagtgtcaataattgcatgtatgatctaacgtctcttcgtatccacgcgtcttccgtgactattccaagatcagacagccattcgatggttcccagaaatttagattttaaagatattctgttggtcccatcctttggaaacagcataagtttaacattaggttttttattgaaatgggatatgatgtgttttcgatgtatttcatcgcatacgtctcccagttcgttaatatttgtccatgcccattggaactgtggtctaataatttgaagaagggcaaaggggatataacttagactgaagacctgtgttccgccaccatttttctttgttttggcatacgtgcaccaatcatctattttaggggcgttcccgtcgaagaaatctttaattaatacacccctgatttccgttgtgtgttttcctatcgttgcggtgggaattccatctaaagctatcaataatgttaaggagggtctgccagctttattctccgcttgagcgtaccactttgcaggggtggggacggcagttttattattccagtaattgagtatgacatcgatcattttggtacatgcagttatccatttaatatcgggcgctcccggtgagtgcatatctctaaaatgtggcacgggcacgttagagaatttacaaaaaaaatccgtagatattccagggatttctgcctcccactccacggggcctttgatagtcaacatgatatatttgtctttagtccaaaaatcatcacttggatttattatggaaaacataccgtttgtgccttccaagatttttatagttgtatacggaaaataaggtaattcccctggcttgtcacctctagatgtcttcaaatctggaagatttgttatggcaacaaattctcagtatggatccggcggaacttctgtcggacaatgcaatctcgtccacgtgtgacgaaaacatcgcagctggacatcattttacgcaacctccgcacgttgaaatgtcagtccaatcaacgacatcggcgggtcatactggagtgatgacgacacagtcgcagttttccaatggcgtacgggatcaaaaccgcgaatcactgtcgactctgacgggcctctcgctggaaagcatcaacaatcaaatcaatgttcaacccactcagatgacctttcaacccatttccccgccgatgcagggtcagaattatgtctatagcaataatatgatcaatcccatcaaacctagatcaattatcaaatcacatggtcattcgatgggggagatgtcatttgcagaccattccttgtatgttaatgctcaaccgcctgtccaacagcctcaacttaaatcccttgtaggtatgcatccatgcatgaccgctacctcacagggtaaatatgagacaaataaaactgtggggccaccctctatttcagcttcccaaattactacgggaaatgccggtataagacccggggaatatcagtctgtccataatcaatcttctggaaacgggtctaagtcttatgagatcaccacggcatccggcgatgaatggatactgactacacccggcgggcaatcctggactctgaaacggaacccccctaatcctccgaataacagaactaattcagttgtcaacaaggcacaacaggtctcgcatgcccaaccttatgtctctgggtctagcgacggtttctatcagggggctgctctccaatcatgtgcgtatgtaaatacgccaggtttcactcctgtgtgcgaaacacagaatatgaacaactcacaggcgacacaactaagcgcatccatgaactgcataaatgcgttatcaactactatggatgcgattgtcacttctacttccaagccggtgggggtggtatcaaataatcggggtgctaattttggaatgggaggcatggagaattatatggataataacagtccatggaaccaatactgtaaagttcaagacattgtatctcaaaactgctcccagggaaaagttgtttcttcgacaccgggaatcgctcctaatctgatgaagggcaacgggttgaatgtttatggccatgtggggtgtgtagatgcggccatttccgataaacaaggtggcaccgctaacgtcgcatcttctctattgaatccggaacatcaagattggatgcgggtgaccgggacgagcacaaatctgttaaacaatataaatgctgaaacaaaaatggagaactatggttttccggaaaatgggaatgtccacggagccgtcaatacagctttaccactaactctatccagtggtcagccctacacatctgtgccacaacatggcgcatgtgaaggaaatggaacaattcccgtggtacagatctgcagtcccaatacggcgttcaaagcgcactacagtttgctcggtacagtggatgaaaacaaccccttgtccgtcagagagagcatacaggacacaagttttagtaatggatgtgctcctcagttgtcctcgcctggaggaaacccgacaataattgcacattcaatgattggaaataacggaaccccgaataaagatgtatgcaagcctacccccagcctacgtgcaataaaaaaattaaactttgactatgatgaccgaggggaaaatataggatttccttccaaactggcagcccttctgtctatgggagaaaacatgtcaaagatggacaatccttgttatggaacttctctagcgcagttcgaggaatcacatcagcagaatgcatcggagggtaaaatatccattgcggatttagagttttctgaagaagatgatgtgctttccagtgcagcctctgtcagctgtaatgacaactgcgtcatgaagatcggacttcagcagcaaggtaccactgtggctgatttacaacaagggtttaagcaacaaatgaacggagaattctccatgtttgcagtggacgagaacattaaaacacaggagatgtcgaatgactgcgcgacaaacgtcacggataatgtatgcgccattcgacaaaataaacgtatgcactgtgaaattgggatttcagaggatggccgggtgcgggaagaggagaagtgctcagacgtcgcaattcacgttccgcggaaaagtgcgcgtattcataacatgaagtccgaaggcgtgacttgcggtatgtgtgtgacggctgcggattccacacggcaggatgcgtctggaggttcgagcagcggaaccaagaaaggcgaaaagttgcaaggactttggaagggataccaggatgacgacgattcggaattaaccgaactgtcggatacagacagcgacaacgatgtccaaaactgtcacggagtaagaaagaccggttccaagacgtactcctcagtattttttaatcctgactatcgccaagccaagagattgcttgccgacattccatacagaagatggattccggacacattcaacatggaagaacacgagggtccattccttccaatagtgactagaccacccactgtgtttattggcggtagacgccggaggacttacctccggcgaagtgtcacctctatcggtcctctgagtaaattaacttacttcaaagaattactgcagagctacgtgttgagaaatagcaactgttatttaagtatcggttggcctgccaaacacagggtgtatatcatgtcagaggagaaattggggtataatcatatacctaccttgagggagatgtttccactgccacccggatggatgattgtccttggaattgtcggttcagagacgcccgcggctctgtataaacacatggtggttctcctgtgtgaaaataaatgggtgcttctgcataattaccgggactctaaacacgagctgtatttcgccgcctcggatttgaaacagtttatggaggagggtctgtctagatgtgactgcatatattatgaaaagtcagtgccgtacggcgtggccatggaagactctgttcgagagttcttgagaaacagtaaaacgtttcagagtcttatggagtataggaagaatatgcacggatttacctggacctttaacggaatgcctggtagactgggcgacagagttatacatatctgcaatcctgaattggttaactcaatcccagcagacgaggccatcagatatgaaggaaaacctttgtatttctttgcatttgtcaccactttcaaatcacaccccggtagcaaggccaacgtattgatcgctgcggataagaacttagggatatacggctatcataaaggtcgccccaggatacggtacttgtgcaagaacgtacaggctttttttagagccggagttagaaagatgtatttggattatgagattccatcgaaaacgttgcttgccgtcagcaaagatgactatctgtgtactctacaaaaagctccttgtctgctcttaaaaccagctgtgtttagaaagactttctctcaggaaggtaaataagaattgctatgtcaagagttttccttgacagttcccaccctctttttttaattaaaacagaaaggccattgattccatccgctaagagatttactgtttctttgacatttatcagagatacgtaatactcggtctactgtgtattgtgtaccttgtaatctctaggtaaacttctgctatttttaatgttgattaattggacattgttgataggtaaactgttctttcaaaatgaccagagattctatgtactaatctctttgttttttttttctgtgtattgtgatagggaaggtttgtaaggacaaaggacaaagttcagtaagatttaataaaataacatgtgacacaatttctgactctccctttcagtaatttttttattttaataatgtccgttgccataaggtgagggcaacgtagggtctgagggataaaaaagtaattcgttcatatgagtagtcggataaaacatttgtagttttttttctaaaacataacgattatctcgatgacattcataccggaataaatccgatataaacgtttccatctgcagatatcttggcccgtttttgtgtgctgacatagcactttcggttaaattttctatcacagctctcccgtagtcacttaaaaaaaaaacaaaaaaaaagacatatgaaattttatagtaggcctacctgcaatttatataagtacggatgaaaacaaagaaacaaacatagtggaaataaaatgattcgcatgtgaattaatacctaatgactagattgaaatccatccatgttacggaccagggtctttggacttggtcttgcatagtatatacaattgttctattgtccgtgaaaggtcgacaaaatttctggcctgcattttgaaacagactgaacaaatatcaagttatagattaaccggcgatgtcctgtgttattacgcagactatacgcgtatacatccacatacacgcacacacgagaaaatggtgtactaatcattcaagtttacccgtggtgacattttccccgagtagatagaacgacacttacatttcaccgtctaggcaggtcggagtcgaggaagatacagaactcagtgaattaagaacgacatagtgatcacagcacgaagtaatcttcggtaacgtgctaaaaaacggtagcgcagccactccaggatatgcatggaaatgtgttaaaatatacacagccacgaaatgcataattatctagcagcaatagtttgttatttaaacaatgtttttttatgttcatttaaatatagtatgaatatttacaactaaatatacaatcgactatacacatggtcgttaacgcactattacatgtgttccaaaaaacagaggtttatcgggagttatcgttatctacatcgataaagtgtacaagtctacatgtaaacatcacaggaaaatatagaagtccgaggccgtgtacatccaaacacgcacaaataacggtcaggttctcacgacagtaggttctgtagctgccattttgatgttctgaaagtatacatctctcgggttgtaaaatacgtgcccaccctcgcataaagcttgtccgaggtgttcatatccatatatttttttttcgaacatattttgtttactatatctcgcttggacagtgaagatgttgttaaccatcagtagtcccgcatttctgaaacgttgttttgaagttccggtctgtacaaagatggtgctgcggattaagaaaaactgcataaatataaaaaaaaactcgggaaaagtcatttgtttaattatggcctttcgtcttctaatccaaagaaagtgaaattaaacgtaaaaaaaaaactctacatacagattgatagtttaacagcgctcaccataatgcgggactcatatgggtcggactggctatatcgtatttaatattagtcgttgtcagtttttctggcaaagagtgccacaatgcgcttacgatggccggatctatgttgctgtgcataaccgaaaaagcaaaaaaaaaaaaaaaaataaatataacaggttactaaaaaaaattcgttcctatcaatcccctattatttaaactcaccgtatagatgttcctcgctgtccgaccagtgacaatatttgtgaggcaagtcgcattccgatggtttccatcagttcctcagtttcgtacagtgcatttttaaacgctctgtgagaaacacaagttaagaaatctcaaatataaactctttcaaacgatacatcgcagatagtataaactcgaactcacgttcaaagaagagaaaataagcttacttacagtacggaagataaataattcttcgtgtcgttcttattcaaacgtgaacaccattcgtgaccttgcagggtttgaaatctgacaaaaaaagcgaatttccaaattagaatttcagaattgtgttccactgctatatggcaaaaccaataaaaaacatagatgtagttttttttttaaaaaattagcatgaatcactcacacgacgtagctatcgtttggacaatgattatcgtttatagggacgtatgcgtcaacgacgtcctgccacggttcgaaatactcagtccgagtccatgagttagaagattgtaacgtaggacgatcatggtgcacgtctcggggaggacaacatgtgccattggcggcaggtttagacttcaatatgtcctctatgctaacggacgcgaagcgcgtgcaggtttcccaatcttgcccgtcgttgtcttttcgaacgatcgcaaacgaggttaacgttttgatagtctgtccgccatggttttgtatcttcaagagttcgatattgacgatcagttcgctggattttgagtggatgaatacatgtgtgccgcacaaagaggcaagatacaaggaacgagaaaaaattttcttgttacgaagcttccagccccatagtttctgctctgaaaggatgtaggtatgcgtgtggggttgacacgtatgcgcgtacatgggtgtggtctgtcttctaagagggggtggagtggagggtggaggagaagtgctgcgacatttttagagtgacaggtgcatccgagggcggggcggggtgtataaatgggactctttttagtgaattcgggatatttatacggcggggatcttacgcttttctatgtgaataaatacacaatgcatgcctttccttgtcgataaaggagacgtggcgggaaggcacaaaaacttgtacaagtactcaccatcgagccttttccagtctgtagttttggcgtagctccaatttactagtcattggacaaaaagctatcgccgtcatcgcggttagtggtttcaggcgctccatataggccaaactattatagttgctcccgaaagcgccatatagcagagagaagtgaaggccgaggccgctagagagaatctgtgatagacccataggcattaatctgtttttcaaatttctcactcctctgctttcggccgagagaggaacgcagattatgatatctccgaacatgatgctgcggggaattaactatgattattatatattcatttatttgttatctcggcggattccgacatcggtgtccgggagaatgagcgcgtggcaaataaacaagacgaaataaaataaaacgctagatccttaccgtgcctctgtctctatgagacaaccgcagctgttatcatcgcaaatggcgtagttcaggaggtcttctatatcttctaaggtagtagttggggtataatctacggggacaaaaactttaaggcctcctagacgtgacatttcggaggtagaaaatttagagatgatttcgggtagcgttcgtcttctgggcgtaggatttgtaccgtcgtaaatgttaaaataaatgctgtcgtcatagtattttgcggtatagttgtcttcgtcgtccggcggcggtgtggattccacggttcccgcatctcggtagaccgtagcattcgacagggctgtcgccatggaaatcgcgcacacgagtatcggcgcagaacatctcggcggtctcatagcgcttagcgttgcggtcgccgttctccgtcttagtcttgcgaaaatgcgtatccgcgggaggaagaggacagaaaggaagatggtgttagataagatctacaggaggagaaacgggagacaaatcctacgaggacgggagagcataatagagcggtttgcatccgggaacattcgcgtgaatgtaaagccacaagaaattaatgcaactagagacttcccaaagatgatatatggctaacgagcaacgtctggcgcgttcacactcgtttaccgtgtgtgactgagacacgtagtcttcaatctctgccttgtaaaatcatacgtgggtggaaagatcgtgcggtgtatcgtcgtcggggagcgtactcggagataagtctggggcgatcatttttatctgcgacgatataaaacgggggggggggtggtatgaatcgataacgaggaagaaatacatctgatcgtcatttggcgatcagtagtttgtcggtgatttcttccgtaaccggcgtgtgtgtagactttagttttggtggtcagatattaagtcttgatcacacgcgtacccgcgcgtttgtagcggcttctcgggtgtcttattttcaccccgcagctgaaccgcactccggtcgggccacttcttttcatacaggcgttgtctgtctgctccggggagctgggctgcgctcgggccgggacacttattcccatacaggcgctgccttctctgctttgggaggtcggactgcgctcgggccgggatacttattcccatacaggcgctgctttctctgcatcgggaagtcggactgcgcccgggccgggacacttattcccatacaggcgctgccttctctgctttgggaggtcggactgcgctcgggccgggacacttattcccatacaggcgctgctttctctgcatcgggaagccggactgcgctcgggccgggacacttattcccatacaggcgctgccttctctgctttgggaggtcggactgcgctcgggccgggacacttattcccatacaggcgctgctttctctgcatcgggaagccggactgcgctcgggccgggacacttttttgtgcgatactgttgctctggaagacagatatcctcgcgtttcaaaaattactttaaactccccgggggggttaaaaaaaggggggtattaaccctaaccctaaccctaggcctaaccctaaccctaaccctaggtctaaccctaaccctaaccctaaccctaggtctaaccctaaccctaaccctaaccctaggtctaaccctaaccctaaccctaaccctaggcctaaccctaaccctaaccctaaccctaggtctaaccgtaaccctaaccctaggtctaaccatagccctaaccatagccctaaccatagccctaaccataaccctaaccatagccctaaccatagccctaaccatagcactaaccatagccctaaccctagccctaaccatagccctaacactaatcctcgcatctggccctaacactacccctctttcaaccactcaccatcaccccacccgctgcccccccccacacacacacacacacacacacaccgccaccgctaccaccacctctgaacttcaccttttccctccatctcgccccacttctctctacacttctccgcccctctattcttactcctgttttctaggatgccgctgccggcgcgtgtcagccacgccctgcatcgtcttccgctgtcccactattggtggctactgttgggtcgacactcccttcgtcatgtccattcctaccttcgcctgcacaaaggtctacgccttcctttaccttggcccgagcaagaatgcctgcatttacatcctaagccttacaagtttctcctgcgttacccttgtctaacaagacaaccgcatcttcttcagggctggcccgcggattcttctctatgtgagtgacatttacacttccacttgttcacatgatttattgtgttttgtctgctacaccaagcacatttcggtttctcttttatacatttgtctctattctctcggtctcagggttcgaccctaaaccctaccatcttcggccgacagcaagttgctaccgctgggcctgatcacgctgtccgccttttccatgcgcgtttctgagccgacacactgcagcggcttccacgcggcacatccgtctctcagttggttaacgggatcgtccccttggctcgtgctcctacaagcgccaggagggtctctgttctgccacgacgtgttccaaggccgactctatctcctgtcgcactccgtgtcgctctttctaaagacgggccttcgccagtgtgaggccatctatcgcgcaccgctgtggcgcgtacggcccctgccgagcctatggacgtgtcgagatcccgacacggccttcttgccgaaattactggcgagaaccgcccgacgcggcctggccgctttctatgccctgtggagactgcatctgggatcccgctcggagctctctcaccccgtgttggagtgggagagaacagagctggtcctgacggatcggagacgcaggtggccgtgtacgcacctcctgtccggctcggagttccagcgcgtttcctcgagtgacgccggagacacatggaacgcagcgacagagaaggcggcggggggaaaagaggaggcggagagaggcgggcgacagcaagccactgacagactcgcaagtccgcacctgacgcggggcctccgcgactccggtcggtcccttcagggtgaggagcccagcgccgcggaagactttgcgaggtgcagaccgctgctggacgaactgtgcggggagggcggctggcttccctttgcgtttctcacggcatctccgcacgtctgtctgatcctaacggagggaggccccgtcctggcgcttgacctgaacgacacctccctgtggcgcatcgcggacgacttggagctgctgctgcgcctggggagcctgctcctgctctcagggctccggcttcctctccgtcccccgagcgggagcggcgaggcggcgagaaagccggggtacgagaaggaagagggaagagggagagcggcgacggcgagcgcgacggccgcgacgtcgccgcgcagaccgacccgtccgaggggggtgacggagaagggacgtgtgacaaccggggacgtccctttctccgcacatcccgaatctgaggaacagacagacggccaccacgggcgccaggaaagcggccacggcgaccagcgcggcggggacggacgaggacaccgcgatgacggcgcgcgccgccacgcgaatgacgaaacagagccccagcagcgcggagagcacgaggacggggaacagaccgactccgggcgcgaggaggacgcacaggagagcgaggtcgcaagaagagacgagaagggaacggagcagggcggtagcggaaggagctgcgggagggcaaagcagacgtacggcgggagaggcgaacatggtgcctggtcgtcgatccccctgtctgtccccaggcccgatccccgcgtgtgggtccctcctcctcatctgttattcccttccccgctgccgtcgataacgcccgtcgaagacgagccgtccgcccgccctcggtgcccgccaggtcccgcggaggaaccctctaagtgttctccgtgcccgccctgcccgtcgcccgacgccccgcagtccgctgtcccgcgcctctccgctctgtccgtcccctcgccgtccaccgcgcgtgtccgtttctccctctcctccctctcctcctcctcctcctcctcctcttcctcctcctccccgtcctactctccctccccgttgtctccgccctctcccgtctctccctcgtctcccagatctccgttcatctcccccattagatctccgggactccgagcaaagccgcgggtgtcctccgggcatcccgtggcgttcccgccggcgccctcgtccgcgccgcccttttccaaaagagtcccgtccgttccctcatcggcatctccgtccgcgccgtgcatcggcaggtcgcggccgccctccgcacagacggcgtgagacgccgcgtgaggtgacggaggcggcgaagggacacgagaagaacatgcagaagaacatgaagacgaagaagacgaagaaacgaggacgaaaggaggggaatacaccggagaccgagcggcggatggagcccgctcggttttgcacgtccgcgataccgagcggactccgtcgccgctccggaccctccacgcccctccgtccaggacccgaggtccgacacgcccccacctcgcgcacctcctccgccaccaccgctgacagtcaccgcatatcacccccatacacacccagcagcagaggccggcgcacacacacgcgcggagcacgcacgagaacacgcgagacatcggccgccgaaattaacggagtctatgcgcgcgccgtgacacggaaaaccaagcggagcgagacgatcgaccgactcctgctatccttcctccctgggtacggtccacacgccagtctgcggagtcacctgagggccggatccgctccgcgccccccgcccgatccgccccgataaaaaaaaatcatctgactcgtgccagttcacacagatgcaaccgatgacaaaaaaaaacacaccaccacaagcaaacgctcgccggcccgttcaccgtccctctcacccccactcgaatcgcgcaggcgcgtcggcgggcagtcccccgaacgcctccacggcaacgctcctcccacgccccctcggtcccccccccccctccctccatccccctccccggagcatacacgccgactctctccgcagaggcggcgaccacagcggcagcggaaactgtaacggccacgttctttgaacagtgacagtaacggcggcggcggctgtcgccgtcacggtagtcgtggcggagcacccggggaggcgacgacggggactaccgatgctctcagatcatcgccatagtgaaagagtaccgaataaaacaagttaaattttgttgtaaataaaaaaaaaatactatgtggaaattaaaaataaaaaaaaaatgaaaataaaggctaaacactgactaaacgtgcatccttctccgtacgtcccctttcaataaatggcggacccgacctctccataaacggagacacgccgggagactccggccctcccaatccacaggtagcccgagacctaatcacaaaactgtacctgaaaccgaaagtatagagggcggcctcgaatgccccacctatgaggcgggacttcgcgacgcgccacccttcctatacgcccggccttccgcgtgcgcgcctataggacgcatcccctcgccccgaaaccgcaacgcggcagagtcggcgccacacccccgtcccccgagttcgcgatgggctggcgccgaccctgccgcggcaacgaaggcgaaacgagaccccgacgcatgcgggcataaagagcgagaagtaaacgcggggtcccgaattatcgcgagactatttgcccgggcccgccctcgtcctcatgcccttccccccgccctcatcccccgacacacccggtgggaaaaacgaaagacacataaataaaacgaattttgttgttaaaaatgtttccacgtgacgtccccggtgattcccggagatgcggcacgcggcggattcgcccgtttacatcggggtccgcagacgcggttctgccagggcgttgcggtgtcggttccgcacagaacaccgcggtccgtcgtcaccgttcaaccgcgcggtagttccgcgattctatggttcatctccgctcacagcgttctctttcttttatttttcactgagccgctccaccaccaagagtgttactgactacaccgtatacatgtttttttatctctccacccctccccatcacagaccatcaaacaccttgccgtatcgacactgactatactcgaccgcggatgacaacggtcgttggtcacaacaagagctacagcggacagcaaaaataagataaatacagtaagagagaggccccggtccacataggaagccaagggcggacgaaaataaaaacccgtccgtgattcacacacgaatcgggggttatgacaacgcgacacacgcagatgagggacggacgcatcgcgatccggcgcgacggggcgcgattggcccacgcgcgagcccgtgcccgcttcgagtggctgctcctggctcgcggcaggccgtccaaactgtacggctatacgagtcggcaccggggagaacggatccacctaccgtggccgcggtactggtgcctagaactccatccggatccgtacagggacgccaggagcgccaccgtgtggggtcaccgctggggttggccgccaacgcacgtgagacccagatccgttcaagactgcggtgagtgagcgccgccgcgaccgacgacgctatgcgcacacgggcgagcggcggggagggacgtcggccgcagggcgagcgggtggagggcgagcgggtggaggccgagcgggtggagggcgagcgggtggagggcgagcgggtggagggcgagcgggtggagggtgagtgggtggagggttcgtcgaaaaccaccgaagacattggctggcggagagtggggacaaaacaacgtcacgtcaggggcggagaaatatagggtgcgcagaccgtcaaagcgcgagttacggaaaacgagtacggatacacggggggggggggggggaaggaaacatggtgaagtctgtgacacgcgtgaccgtcagccggcaacgcctgccacggcctccggcctcacagacgactcacggagtttcctccagacattgttttttttttttgtattcatcggtaatgcggtatacgtaaattccccgcaaaggtactttccgttaaggacggtacaggcggtatgacttccggaacacgatgattacggatatcctgcatagtgtacaggagaccgcttttttttaggttccgtataaaacgtacgtcggcgacgtacacacaacggttaaaaaaataaaaaaaaaagaggaaacagtaaagctcctcctttcctctgtgttatcgcgttgagttagtagtcgccattgctgttgcgtatgcttttcgcgttaacggtacgcgacaggatacgaatgcgttacacgccgcaaaggcatccctacgatgactctatgcggcatctcccgttcgcgcagaaacgcgagttcccgggacgccagtcgtgacgtccggccgatgggatgcctttgcgtgtgcggatgttttctgctgttttataggaacagagacaagagacgaaaatagcggaacgcccactataacgtgcatttttctctgtgttttgcgttttcatgttttatgattcttctacggtatcggccggaacggtcatcctcgatccttctcgtacgcgtgtcccgccccagccctggactcgagtctgtacgtatgttgcggatacggagaaaaacttcaacccgtgggcttcgtaagctcgtatctgacccactccccgctcgacacgcttcgcgtgctcctggtcggtagagacggagccgtgtacgtccaccacatgagggcggccagactctgccgactggcgtcgaacgtaacggagtttgcaaggcgagggctgcagcgggaccccgtggcgtatgaggaggacctagagctgccggaccggcgtatgtgcggaacgaacgtcagacatctgttcgacgtgatcgccgcggccgccgacgaacacgacctgctgaccgtcggcggcctgtgtcaaacgcacgccggagtgagctgtgaattactagagaccgtgcgagatccgtggacggcggttccgggcgtacgcatgactctgaccgtggcgcgggctcagtatcgcttgtggcccgatgcccggagacagctccgcctgcacctgtacgcgggacaccccctgggaccgtggatagtgtgcgccgttctgtctcgagagagggagacgcagacgccgtcgcctccgataggcagcggaggcgtgactctgggaaacgtgcccacgccggggccacgcgaagtggagacggcttgggtgatcgtcacctggcgggaccgctgttatcgttctggcccgataacggcaagatctgccgtctggcgaactcgttcgccgccctgtggaggatgggccgcgggccatgagaggacattggacgtattcggccccgggtagacatctccccgggaacgcttggccactcctgtgaacacgtgagaccgccggtcggaaaacttccccggcaaagagcgtacctggattagacgccacggcggagacgtaaggatgcgatatacggccagagacatgaccggaggaagatcatgacaaggatctcgaaatataaaacaaaaaaaaaaaagtgaggagtgcgcaaacgcaagaaaagaaaaagcagaaccgcggtggagatgtctatccgcctgcgtgtatgtgtggggtgtgtatatgtgcgcgtgaccgtatccctccctgcctttaacccgatgagaaataaaatcggcgaatgtacacaatcacacacaatgtgcttacgttccgtgttactgacaccacataacaaaaaaaaaacatacttcctgtccgtgagacaccgccgccctctagcggagttgctatagcagcgcccgatgccaacgcgacacggtgagtcgcatagatcgggactgcttgaaagcgcgccacattcgccttttatatagacgccccggggagtgggaggagccaacatacacacgaggtcggtctggggttggagacgaacgcggaaaatcaacggcgtaaaaaaaataaaaaaggcggagacacatagccttggcgggaagacgataacaggttcaaagatagacagtgaaaaaaaaaaaaagaggagaccatgacattgaatacacgtgcggcggcaatccaatcaacgggacgtgccggggcgcaaaaaaaagtatacggaagtgcatgcgacagacagtcacgcggaccgacgacaaaggccgactcctagcatggcaactaggaaaaaaaaataagcaacgctgcaaaatactaacaaaggaaacatcccttcaccccctccctaccccgtctaccacaatacccccccccctccgtaatcacttctgtccgcgtttctcccacaggcgcgtgcacacgcagacacgcagacacgcacacaccacctctatggcagtcgcgggcgggcaggcggggagcatacggggggcagatgtaaagtcaatgaggaacggcatagcgcgcgacgtgccgtcgtctcggacccttgctattctggcacgacgccaagggaagcctctggcgcaatctataaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaaccctaacccatcccccaacgcgcgcgcgcgcgcctctatgggaggcgccgtgtttttcaccaaaacgcgcgccactgcgagaggcgcgtg

SEQ ID NO: 273 - protein, 88 aa, herpes simplex virus 6B
MPLPARVSHALHRLPLSHYWWLLLGRHSLRHVHSYLRLHKGLRLPLPWPEQECLHLHPKPYKFLLRYPCLTRQPHLLQGWPADSSLCE

SEQ ID NO: 274 - protein, 647 aa, herpes simplex virus 6B
MRVSEPTHCSGFHAAHPSLSWLTGSSPWLVLLQAPGGSLFCHDVFQGRLYLLSHSVSLFLKTGLRQCEAIYRAPLWRVRPLPSLWTCRDPDTAFLPKLLARTARRGLAAFYALWRLHLGSRSELSHPVLEWERTELVLTDRRRRWPCTHLLSGSEFQRVSSSDAGDTWNAATEKAAGGKEEAERGGRQQATDRLASPHLTRGLRDSGRSLQGEEPSAAEDFARCRPLLDELCGEGGWLPFAFLTASPHVCLILTEGGPVLALDLNDTSLWRIADDLELLLRLGSLLLLSGLRLPLRPPSGSGEAARKPGYEKEEGRGRAATASATAATSPRRPTRPRGVTEKGRVTTGDVPFSAHPESEEQTDGHHGRQESGHGDQRGGDGRGHRDDGARRHANDETEPQQRGEHEDGEQTDSGREEDAQESEVARRDEKGTEQGGSGRSCGRAKQTYGGRGEHGAWSSIPLSVPRPDPRVWVPPPHLLFPSPLPSITPVEDEPSARPRCPPGPAEEPSKCSPCPPCPSPDAPQSAVPRLSALSVPSPSTARVRFSLSSLSSSSSSSSSSSSPSYSPSPLSPPSPVSPSSPRSPFISPIRSPGLRAKPRVSSGHPVAFPPAPSSAPPFSKRVPSVPSSASPSAPCIGRSRPPSAQTA

SEQ ID NO: 275 - protein, 103 aa, herpes simplex virus 6B
MTTRHTQMRDGRIAIRRDGARLAHARARARFEWLLLARGRPSKLYGYTSRHRGERIHLPWPRYWCLELHPDPYRDARSATVWGHRWGWPPTHVRPRSVQDCGE

SEQ ID NO: 276 - protein, 212 aa, herpes simplex virus 6B
MRAARLCRLASNVTEFARRGLQRDPVAYEEDLELPDRRMCGTNVRHLFDVIAAAADEHDLLTVGGLCQTHAGVSCELLETVRDPWTAVPGVRMTLTVARAQYRLWPDARRQLRLHLYAGHPLGPWIVCAVLSRERETQTPSPPIGSGGVTLGNVPTPGPREVETAWVIVTWRDRCYRSGPITARSAVWRTRSPPCGGWAAGHERTLDVFGPG

SEQ ID NO: 277 - protein, 244 aa, herpes simplex virus 6B
MRQTVTRTDDKGRLLAWQLGKKNKQRCKILTKETSLHPLPTPSTTIPPPLRNHFCPRFSHRRVHTQTRRHAHTTSMAVAGGQAGSIRGADVKSMRNGIARDVPSSRTLAILARRQGKPLAQSITLTLTLTLTLTLTLTLTLTLTLTLTLTLTLTLTLTLTLTLTLTLTLTLTLTHPPTRARAPLWEAPCFSPKRAPLREAREKTSPPGRARVVRACRRCAPRPGSPHLPPPKNGRGYGGGWRVV

SEQ ID NO: 278 - protein, 151 aa, herpes simplex virus 6B
MRRAPRRAIDLSTDPRPISVMQIRTRTRTDMPTRPHRADCHVSESIHTHEKIHTRKYTQENTHTQKYTHKKIHTQKKIHTHKKIHTQKNTHTQKNTHTQKNTHTKKYTHTKKYTHTKKYTHKKIHTHKKIHTHKKIHTKKNHFIYALFSQC

SEQ ID NO: 279 - protein, 85 aa, herpes simplex virus 6B
SISLFHTTQSEEGCSPLMPNLAAEVPCRPFVNLAQETGTTNLLVAGSRPTNTGVRNFVINLTVGESSSSRRTANRILLRSFTSLL

SEQ ID NO: 280 - protein, 503 aa, herpes simplex virus 6B
MEIVTYKTASARSPTVTWSSGFGRAIASIQKRHQENIRKPLRFYSGLLHCLIKQYEHCLVPPNKSIRFDKGKIEVAALILDLGHQVLGRQIHVRQRIYSWTSITLPKLFTPRELYFLVASPEDEDIVFNPTITKGGWISGSFSYPVEYRSNFSLTGMSANVLMVPFVPYRYPLNYARFISSIDLMILNEQFPEHECGDIQILKQRNYLYLGVIKNLTWKKSVTGTGQTAPHRILKASFIGSWPDTSLPDRVALRFFNNTRFTIHCHEFAINIENLGLVKNKEKVFGTLATVCCEQIPSLLTTENLPRYLIVQFEVVTQIEDPEPLLFSSNPKLYFTGDVLNATMQLQHNPNYYDLLVHAPYDIHFYPSRCHIVILPIRYFTRGDKQILISGYQNEGFFETQVMLWAPGTPLHITLRSFSPNLILPQSTPIATLFYVERMTSQNTEQKDVIAKLSENGHFIGNLKLPRENFLHHDAITDLSLAAIPKDSATPGPGTVSSSVSPS

SEQ ID NO: 281 - protein, 107 aa, herpes simplex virus 6B
MAHAKKRARRKLLTSTDDPILSSTFTMRPTSKIADAEIISREHDYIASKTQADSKKKLSSLSVIFDKTVLFEFYGIGDNNEKAIVYPIDPDFLLCDSENNCTLSPFL

SEQ ID NO: 282 - protein, 605 aa, herpes simplex virus 6B
MEGSKTFNIPTFVLDENCNFIPDVLSRANAKFIKEVLIRDSYNAVCLANSFIPMATQTVEQILIIITKFKFSRSRDLLMSVFRLGVHINRFYAGKNQVKHMITMMKSLFDTEEAMRQLDRALMGLFVDARDNSYMPLIALSLHENGLPDSKFIKAVRLIQTTVNSFHNRPDADIEQYAEKLRAYNYLYKIPKYTLKEAVDIYSDNLKDLTIGVNKKPTLLFTSSDDAYLSHIYNDLLFLTSTWNMIYNCKKEIRRLNTWIKYEINSIMETAVLVGFQLPDLKETILDLAALISNMNLVSPDKELFPHYKLILAKLFEICIFATKANICILPSFIKGHLIEFEDVLKRSNDDEDLNYLLLKSRDSDDEYDEDKPPIQVDPGRVDNVLTDSDFFNVTPENAFSSIAIMPISYDKTIDVEDNEIQVLEVEMQSLSAVVYGAVASKYGLSLEQVIRKLNQNEGRTSSRASPSHSTSTVPYSPPQRHRSTPTSILRQRVPIRSNSRSSSVSFSQEDSNRSHYSDETNISDYSYPMADLELEDEEPMEDHPHSPQSTSSNNSMSRQSRALQNGQRRRAPTMVPSSQTRRQNNARPRRVARRLTEMMNDARL

SEQ ID NO: 283 - protein, 1082 aa, herpes simplex virus 6B
MTHDNRQLLPQETKLVTPNKDTLSSRYLHVLIIDNTLSTIEFVYMVVKAVLTQADTLKAFEQRKNRPTNRILGLSTSVSKRYINIPKFSSSGANNSQGVKTLAAIRKFSLPDKNCFRNFLSFSTTLFKVPASIDIYFLFFTASTVSTMAARALDLEFILSSLKNSTSPESLLAATAKIEILSLAADSVTHNRVIAFINRLPPKKYHFDLIREYTVFYFLNSTTLTSENKLLSAELLHEELSQIRSSSSPGTELENLNNAEVLYVFDRILNSIKMLKNELSSPIGKLRVQPAANDPGTDKTIKYSKIQSIIQKVHSFTRENSLLANCRAVVELIDDLYRKLYSWFLHILTFEDIQFPGDTFLDRLLKMDYCFTYYPSSNRHLIDLFEKTLDNQTSTDIDKFFDTSGNSPELLYQKTFSLKIFSKNLTAQDNGLYIYPLLKTDLSILDFLGTENILFHRGLIYHILHQKTIPQERENDLNKINQFFATVIQQVIETRSSCLPASLSRLLDTIFHFNRIGLNIETCRIYVEILSNHMATPDTQPIINTFTINLIHIVFTAHVFFICMENFSPTFLFYNRKKLILEQQRAILIIERNEYSTLWKQISDHIDCLFNISLSESFFKEYTKGGNEEHKQFLYKNLFEKWGDVFFPFTYSVTTSKNSTAHHITTLELRAICKEVYQSDSPEAYESLLPYSTHPAFKTLFIKIYVIPMVTYITNLTFDKLQSDYRLITLIHACKLLLPSQHLLLHYMVWLYAFSINVDHIDLGTFTVIKSVILKIADHINVMKHTIYSPETNLLVSILLKAYTDYLKKYVNPWIKQTITANFSLLQTYITFTKQCASILATKCNINLDNLFISMTIGTEKIDTTSFYSFIATCRNLVRQHEEFKKSLKTIETSKTALTNMLLNIITSVSSSKELLTNEALQKFIDTVQRISQHVNETYQLISVNLEKCKISNDILIESLKKTISIVDVLSSDAILNTSLTSRCLEAATLAVSNNSFTILEIKKDAVAVFKPFITQLFESMKPTTSLYKKLMATQKLTTDRIPFLDIFDDRYNLVRHVERQLNWYAAYAEAAQQDLIASLTF

SEQ ID NO: 284 - protein, 2077 aa, herpes simplex virus 6B
MKIITSSTNQNDSKYGPRAGKQCMSNSFSFLHTVYLNGINNSLNAGTIDAIMEEGYHLDTASTLALMLDNSDSQDYRLLTEIPRRIHSRYGVTQHELSRPFNGTLDTQKIDNEVYFGLIDFILYGKTKNCPAFAVITIGVVSRAIFFLNNTLYLFDSHPTEREATAAIYICQDIEEAYELLTAHGTEGFYYDASFIFFIETSNLSLSSHDAELLILKTYKDPDIAITLDKFSSTEIHDIKKTDDIESQQDLVAAKTTDLERAPQKRKKNSHSLELELNDKKKKDTASLTYYATEVDLIPSFYELRSQFQSLFHDLKSFPIMKSQFNWTIYLQDSPMNPNQPFATPFLWNRVFHLLCQIVDVFVGVGSTNDDSSKQKQQTIFINYLLPFKDFSEVFNEALTACQENNLDILLIYNNYLCKTTTFRTLERILLSKFLAIADNEHEKHYEWVKSWTTQMLQEMPKKLDDIENYLKAYVSQNPVKHFHEFVCLNKAEKHNIAVLLNEKRKEIQEDIERDKNIFAQISNFIDKLGETPALPIESENVHKVHTSDITEAIVPRFMTESIELPNISTLNNTQQLSLEKQISEKLTNTIHTLRNKFTKIVQDNYNNLAAGFMPVTELNCLFAYLVNLYFNIEVLKHSGLNINTELLQEVEKLYDNTQFLRFGTSHFNINNLSNFTLSIRKMFVDFYNSQKPSDRASEILAAIESILADPSKNKTIVNIEMIKSQLEELGKMEISTTENKQTAEITKQILGDQELTPIYDFLHHLSAYNLPNTTTVKNLHLHFILEKRPDIAAILHDKIQSILDICIDDMLNDITVPEQTFSTVLFLVDLFPNSTEKTALFESVLTLRQLAKKCANLKTLEEFDDLAQFITTNSEQLQNMMKQHFGKKIPTLMDHIKFLYSQKIITAEEKNWIQRAKTAVITSPEELTAFLATAPTKHALQTCKPELDKALQRHMEEQMKQTAENDKKHILTIRNTLEKRLNDILLILKNGQFSSLETVHLNLLETFLKQLQDNDLIIHFTHALLPVLKDIETTISKTISDILEKILIKTPLNPEQMSKEEQKYTPLLSFLSKFKKTTFCTEDVKTEIDQMQKSITFLTKIATSTNKYTRISHSVYGQELNLYEERITELKKETNKIKEPLSKEYAVAEKKILLSSQDAKTNKIYLVLNTHTLKEIKNTQFRETASAKALTVEVNNKENQLQELLNHFNAHLKAKMDQNHITKLSFDTKWTAFVSDSRLYFPDFVDIKLQDFISDPFKVISQLMNKAANEMPYIQAEITLKWLTQLVHDINKFCLSAISEFGKEAIPFNYAALRDLEYQINTKYVEIENKVICNETVENTKNIPKLTKLLKELDPKRVAGGQKQYQTLMNKILTSETSMQQTYEKEQLKKEYFETVNNVASFKLAFNFPKQRQNVERLMEKFKSLPKSQPFEKFPEENDLFSDSLITENYINGLRALLNFITRAQNYIQNTLLKQWAVFQQQNFIPIDDSVANVKPISDLYARLRIERDRQVFYQVNSVFGTQLIVDETGVPLQFHNIFYNAVVKFFSLNYKQIHVPEDTPRLVSSQYKLLSVCKSFIIILQQFWENIITLDLGSDLRDGTQNFKRELIPNVNLKLFIYIITQAWTASEDSTVSTAFELPIKQFTLLILCSHPEYLYGCLSHPTDLVINSLAKSIDKDSLYDTFVVSHNPPEKPMHLMRSICIDTQLWQSAKLMKDTFQQTFFTQLCPQNEKFFIYLTAFLILPYKFLNYIWIQYKPITFTQRSYQNLIKDLCSEYVHQNKITMSSVTPHEPDTIKSGEKITSKITVHKAQNTPTLTRLQAQEYVFDYILYSFLTGYEMTFAMYIDTIEKTYLLCMRHLENVLHDKDFQSVLRARTFDINYILKQSWTKNIVEHSIFSVQLNKIVSYLNHTNRATPNIPLILFNYDNEVVNVYLPPMSTNPKKVAFYIKNPFHFPVQEYEATDLISFHLYPKTTDILNQLPPNKTVSTRPYNLSSETLTTKNLSEPKFKQPTVTGLMPKSQSIILSTDTNVLETSPDIKANTASAAIKDVTLAREQISEFSESINTTLSKLKSLYL

SEQ ID NO: 285 - protein, 482 aa, herpes simplex virus 6B
MYKGWDSEALSIQSEIVNEILLYCYLTPQPPIPSETTTATSPTNIENEISNLESSENLEELKRLSVALNIDRRCNICSIVNLCLKQNKSWIYDYSLLCYKCNYAPKTPLSLLIVSAEFIMLIRERFPNINFDGLFQNNIVSIFDFHVHFFIHRCFANTVNDHIQSENITLITCISIDPTKRDSIPHIKIKKFLTKKMNPKKTQNPELNKKLTVPMKTRFTTLLFYMWSGTNVFDRVPFTDLTIRKHRFIKNLYSNKTDIELTAGPILLAQIPFSITKNKTTSVCLLCELMAASKQDYLFLKYLHQSIMDYCQNNLKMIDRVQFVIADIFEKTKIHMHVKNLSDYSKAIFDNEFSFSDDNFTLDTHVYLILRQTGTVGVYKHFFCDPLCLANCKTINPEVLFNTTDAGEIQDLKVTICYRNEYLSIVEKHVWLAIHLFKAFQIIKPNHKNKTQIAEFLKDFTNLLALHHFDIVDPIFTVNYYV

SEQ ID NO: 286 - protein, 264 aa, herpes simplex virus 6B
MTVHKNRFRRSRSLSVTHRIQKRPDHREKTKLYLQLKLHDLHAVFNLFPEYEQKFLAIIKLPITGKEPIDVPFSLSNHHQHTCLEFSPYANEQISKSACLHCESVSVPTSSDAMVAHLNQVTNVMQNRFYFYGFRKDMELIRMSAKQPTIFQIFYIVHNTINNIFPIMFEKKQKLGMHIVFQSRTLHIPCECIKQIIAVSSGYNVYLDILQDSVILTVLCETLDTNTNIHIDIGMLQKKLEEMDIPNEISDRLEKYKGHLIGFH

SEQ ID NO: 287 - protein, 231 aa, herpes simplex virus 6B
MPLGYWGVMGNCFRRLSLFGQPTQANYEMLCSSDDLESEELTYFLDMTYKDFGVYQNDIISHQKDTETMKTLLGLLPMYKKTKLRHTIMERCLSNCPNHVKDALCVELMKAEKILQTMDVVFMKTLIGEFSMCTDNLNQLLNKFATDQSTLSDVEKINSLIEIDGENSKRLLVELDPILHEETGLYQALPNVVTEAPSEKVKSIHVESEGESVWSSVTEGGIMKQEKGTGV

SEQ ID NO: 288 - protein, 84 aa, herpes simplex virus 6B
MSCKKGARQRLYVSLWLFYILVFAAATEMDFYSSECHSHTYEIVLNSFSSIWLLINLFLLLCSFAIFLKYWCYKTFASETVKGY

SEQ ID NO: 289 - protein, 252 aa, herpes simplex virus 6B
MSLTGLPDIRKKIGQFHHLRIYKQILSLQGNFARLNYFLGDVFPANLRSASVSVFFEVRLGPRIPDCIVLLKSVDAKDEFAFHCYFFEFKTTLGKSTMQSVHHNCIHQAQYLQGLRQLHQSISFLDQYLIADEVLWNVVPVICFFRQWGLKLDFFKKFSGKTKRLSFSFICDLFARSQDGAVQSLLSIPNYTNFRRACQKHTDLYRRRYQKASKSVLTKTSGENRSRASRQVAKNAPKNRIRRTAKKDAKRQ

SEQ ID NO: 290 - protein, 301 aa, herpes simplex virus 6B
MEKETKSLAWPATAEFYGWVFIFSSIQLCTVVFLTVRFNGFKVGREYAVFTFAGMSFNCFLLPIKMGLLSGHWTLPRDFCAILLYIDDFSAYFSSWSLVFMAIERINYFCYSTPLLNENSKALAKVCFPIVWVVSGVQALQMLNNYKATALQNETGQCFLAFLRSGHDMWLMLVYSVVIPVMLVFFYLYSKNFMLLKDELSSVTTYLCIYLLLGTIAHLPKAALSEIESDKIFYGLRDIFMALPVLKVYYISAMAYCMACDDHTVPVRLCSIWLVNLCKKCFSCTRREKGSDLEVGIKMLK

SEQ ID NO: 291 - protein, 528 aa, herpes simplex virus 6B
MSKVWVGGFLCVYGEEPSEECLALPRDTVQKELRSGNIPLPLNINHNEKATIGMVRGLFDLEHGLFCVAQIQSQTFMDIIRNIASKSKLIAAGSVIEPLPPDPEIECLSSSFPGLSLSSKVLQDENLDGKPFFHHVSVCGVGRRPGTIAIFGREISWILDRFSCISESEKRQVLEGVNVYSQGFDENLFSADLYDLLADSLDTSYIRKRFPKLQLDKQLCGLSKCTYIKASEPPVEIIVATGKVAGDQVQLTTEPGSELAVETCDVSVVHGNYDAVESATATTAMSNQNLPNTTPLLSSPPFSDCVFLPKDAFFSLLNVTTGQQPKVVPPVSVHPPVTEQYQMLPYSESAAKIAEQESNRYHSPCQAMYPYWQYSPVPQYPAVLHGYRQPKTFKKRHFQSDSEDELSFPGDPEYTKKRRRHKVDNDDDKEMAREKNDLRELVDMIGMLRQEINALKHVRAQSPQRHVVPMETLPTIEEKGAASPKPSILNASLTPETVNRSLAGQNESMDLLKLNKKLFVDALNKMDS

SEQ ID NO: 292 - protein, 772 aa, herpes simplex virus 6B
MQHTGNCETLIVNSCFGSTCARSIPVFIDSCDLTAEVSRDEETRLARSVPVVLEKIESIIEKIFQTSGPNIVHDKDRAKIALCRLLLGPVAVPCFCEEWDTNDYLSKSGCKCLGPILYIHTSRCRCSDIPVFKFSIMKDYYASHVFRGLLSLKEWNTHLPNVLCTCELSMSDRYVATVFPKQNSIYLEYYPYFLCYLCRYLTVIEIEQCTNDLISLLGPKVAQRVIIHFKLLFGFRHKPHMGTVDSWFWENFFMLELHKLWLTVVKHNRVTTDFFNVVYEKIQNYKQYAIKTLRMSSKAVPAIQRFCLAKFKQQLLYLNIKVTVKKNKRELCLNGFVYGKTLYVVESSQLIFRNLLLLYYDYSLPGECKTNEENVLTTHYIRVISRLSFKQSRSAVPPGVRPDFTFVAQLPKRKELPNVPGGIDFAEITSVRHGAVILNAFNTNKVMNLKATISKRANFVYHRIPKTMTHSFVMYKHTFKEPAFTVSTFVSNDDLDMSSLNINIRGPYCDFLYALGVYKMHVSIQDLFLPAFVCNSNNSVDLQGLEDQDVVRNRKKKVYWITNFPCMISNANKVNVGWFKAGTGIIPRVSGKDLQNVLLQELNNVREIPGLVFDMDLHQLLVLLEQRNLHQIPFLVKQFLIFLRLGLLMGYGHSRRNKVHDIMLHLISNGLFDFNKNSVANTKIKHGCALVGTRLANNVPKIIARQKKMKLDHMGRNANSLAVLRFIVKSGEHKNKTVFIKLLEYLAETSTAINTRNEVARLLQTLTTNMKT

SEQ ID NO: 293 - protein, 346 aa, herpes simplex virus 6B
MADEWFDCAIRLDSETIAVHEIFNSDLSKLLNLHSKTVYMSDLCAFISGCVNRNVGKLTIYWHVYGDIIYALTGILHCVKITIECGERIADGRYRLYEVPKLFLMRGQSTPLELKWKHAVGIATTNKPLLTHVLTDVLETSPFTLPDTLLSVQELSIFRERLSYIYYVLGLDVDIVARTEREIFQKCAELARLQQVFLIQGNIMENFVLVQACLFQLGADGLWEEMSGSVRPRPELMSSAFIQHRVMVNNCYCLAVIFNAIYKHKVSLPTVERSHEIVHRVVQEYYKSYVNAPLSVFVCATKVLTLFTEEYNFQSALVFVSQFFQVDVEASRADVIRLFLACLKGD

SEQ ID NO: 294 - protein, 87 aa, herpes simplex virus 6B
MNSALNEIKDDFENCETKNDLFKIIDKISKNCNFIVEQVESLPRRVDSAAILFDNLAVEIFNDVIYRQNGDGVPAKIRQGNGQNIDT

SEQ ID NO: 295 - protein, 442 aa, herpes simplex virus 6B
METHLYYDTLYQYQGGVYPAHICLPTDAYLPMRVDCIESLYFRCVFFKNGMHYTEWSKLKFTVISREIKFKDVLKNADFDELFTGLVVMTIPIPIVDFHFDIDSVILKLVYPQLVHREIVLRLYDLICIRPSSDRPSEVSAKNIGIDFYQLTSQGNRQTPDEEKRCLFFQQGPLEPPSTVRGLKATGNAKPMQIPAHVNEKMTESFLSDSWFEQKVRCKKILDFTQTYRVVVCWYELSFSREMQIENNLLSASQLKRVNAADFWDRTDRYLRDIGSRVLTHIVKTLQIHNRQFKQKFNCNFPVNFSFEHLLSFMQLGKDFWILNLTLDSCIIKAIICFLGFRNGRKSFLAQDEVWGDLIDCSKGSVIYGEKIQWILDSTNNLYSTRREKQNKSWELYVDCCALYVSEKLELDFVLPGGFAITGKFALTDGDIDFFNWRFGLS

SEQ ID NO: 296 - protein, 353 aa, herpes simplex virus 6B
MWVMSQVRSMEPDLTLAAVYQAAANLTEQDKEIFSEAVKTAFSVCSSAAPSARLRMIETPTQNFMFVTSVIPSGVPSGEKKTKLNIDAALDNLALSFANKKSKKMARTYLLQNVSRTQDQQVAISGTYILYTKKHIETSLMLDKTKLVKQILEYAETPNLLGYTDVRDLECLLWLVFCGPKSFCQSDSCFGYSKTGYNAAFPNLLPPYLYECGQNNGLFFGIVQAYVFSWYSDFDFSALEISERARRRIRSLLYDLKQKFSEQEISVLPVASQMCIFCALYKQNKLSLEYVSGDLKTSVFSPIIIKDCLCVQTTISTTQMLPGTKSSAIFPVYDLRKLLSALVISEGSVRFDI

SEQ ID NO: 297 - protein, 563 aa, herpes simplex virus 6B
MDNGVETPQGQKTQPINLPPDRKRLRKHDGLGKGVKRKLFAEDSSPLKKQIPACSDMETLSSPVKFGCKSRSASALDESFGKCKHETACDCSAIEELLCHESLLDSPMKLSNAHTMFSSDKWKLELEKIIASKQIFLDMSENVELVAYGETLCNLRIFEKISSPFLFDVQSEERSYSVVYVPHNKELCGQFCQPEKTMARVLGVGAYGKVFDLDKVAIKTANEDESVISAFIAGVIRGKSGADLLSHDCVINNLLISNSVCMDHKVSLSRTYDVDLYKFEDWDVRNVMNYYSVFCKLADAVRFLNLKCRINHFDISPMNIFINHKKEIIFDAVLADYSLSEIHPEYNGTCAIAKEYDRNLQLVPISRNKFCDMFNPGFRPLVANAMILVNVCEAFDGENNPLRHCNLDLCAFAQVVLLCVLRMTDKRGCREAQLYYEKRLFALANEACRLNPLRYPFAYRDACCKVLAEHVVLLGLLFYRDVVDIYEKIYDFLDERGEFGLRDLFEATFLNNSKLTRRQPIRGGLASLQSSEYGEKLLHDLRALFLITSSADLDKDTSSLFQM

SEQ ID NO: 298 - protein, 488 aa, herpes simplex virus 6B
MDLNQISETLSAVAEEEPLTMFLLDKLYAIREKIKQVPFSIVRLCHVYCMLIKYNASNNNCILGRKLIEEMQQFLCGARVDGSEDVSMDLSELCKLYDYCPLLCSALCRAPCVFVNKLFKIVERETRGQSENPLWHALRRYTVTATKLYDIYTTRNFLEHKGQQFFGEAVIYGAKHERVIRHLVAIFYVKREVKETLGLLLDPSSGVFGASLDACFGISFNEDGFLMVKEKALIFEIKFRYKYLRDKEDHFVSELLKNPTEKSFSDFILSHPVPAIEFRERGKIPSSREYLMTYDFQYRPQRKLRTCPTPAILTPHIKQLLCLNETQTSTVIVFDCKSHLSEQKLSVFQKAVFTVNVFVNPKHRYFFQSLLQQYVMTQFYINDHSNPEYIESTEVPSVHIVTALFRRRTEEERSLHLVIDETEYIEEEIPLALIVTPVAPNPEFTCRVITDICNLWENNICKQTSLQVWAQSAVNQYLAACVRKPKTP

SEQ ID NO: 299 - protein, 780 aa, herpes simplex virus 6B
MENRFQNDTLFSEWFGQSLSDVRFPDNVTVYSQADSAVSFENVRQPIKLVRAAMGSGKTTALIHFLKQVPKELSVLLISCRKTFAAEILHRFTLNGLEDFELYCDITERQINNRKVIVQIESLHRLTENYDVLILDEIMSIIKQFYSKTMTKTKEVDCKFLSLIKNSSHVIAMDATLTRHVVEFFAAFKPDTQIALIRNTFVSAMFSNRVAYFCDTFFGKEFSFFARLEDKLRWDKKLCLFCSTVLAAEYMHDLIRSRFSLKKVLLLTSKQGKCSSIESWIRYDVVIYTSVVTVGLSFEPVYFSSLFVYIQLAKGGPDMVSIFQSIGRVRRVIDEDIYIYMNPVLIKSYDPLAPIAMPPCSDWSVAEQSIISESCIDFRGKCSGAHKYNFCSVLKCLFRYRHYIEKTTITSLSDSLFLLCSLLCENSIKVDIVGNGFPMRKEVFLSFLQILVEECHFIEKKITLPGDNMTFQEIISSRETIMNGDFYENGNQLLHKDYITDMGKFRATFLSPGVDIFIASDIVSDLKNESKRYVFVNVWLQKCVSAGVESTRIERVFTERIKSYVLPKSFLCDEYFVLGDISGVYEWGMLIDLAFLAEMIRKDLKLKSCTDTTTDISEDDLLLCAARRSSDILQIMQLVFTVHVQFFQRYSLQTLQLFNKLRGMRIVTGVFSIEKFSISILRLFFKCAFNMTLSASKPRYIPGKAYRNLTKNDLENMLDNWEISRTNLKTCKELRKALTEASRARRKQTIYKLQGSDISLSVSEVGVFGQHASPGVCVSS

SEQ ID NO: 300 - protein, 824 aa, herpes simplex virus 6B
MSISSLFGGRYDNKFLLNMSSAPKIELIVDKVASLSERRLEGRLPEDWFRHIMDPETEFNSEFADALCIGIDEFAQPLPFLPFKALLVTGTAGAGKTNSIQTLAANLDCIVTATTSIAAQNLSVVLNRSKSAQVKTIFKTFGFNSSHVSMSERQSYIANDERSIQIQQKQDLSIYWNVISDIAERALGAVACKTKELPDLCESSVIVIDEAGVILRHILHTVVFFYWFYNALYKTPLYENGIVPCIVCVGSPTQSNALVTSFNPLTQNKDVKRGIDVLSALICDDVLSKYCEVDNNWIIFVNNKRCADHAFGDFLKHIEFGLPLKPELIEYVDQFVKPASYIRNPMNEIETTRLFLSHNEVKNYFRSLHEQVEVTNRNNLFVFPVYFLIKNKTFEDYKSEIGNFSLEIEPWFKSNIHRLNTYSQFADQDLSKTVQLEEIVLEDGSVEETLITCHLKHIRNSSIGVTSKIKASTVGFSGTYEKFVELLQSDLFIEKTSCEQTIHAYSFLSGLMFGGMYSFCCSEFTTPEVLMEIKNIKMPSIEFLESEMSRMSRDVQTVETDERYDFGLVDDGLSDMDLLEIDPCGDPFFTRYSKLPLTNSLSFEEISLLYTTFKDIFISRFAILQMHTKGKFGKTLLVTYNRNNVSRKQCGEIYSHLKSFYGMLTYAIPANNYTLEGYTNDNVVHLGTDKQLPQILYKKGLPRLVIKDEMGFISVLDNNVSKFVDVVNGQSFHLCTTVDYATVSKVSMTITKSQGLSIQKVAIDFGSDPKNLKLSSIYVGMSRVTDPNNLIMNVNPLRLNYENDNFIAPHIVKALKNENTMLIF

SEQ ID NO: 301 - protein, 345 aa, herpes simplex virus 6B
MYAEERGYGSFDNVIQAYEQIISQSLHLKRFEFDNGCFIEFLADSGTCETFSKGWISMIYWTSETDSMGSLTVDIGMDEGKCRTYRARGLLLCSKSITSISQNTEGRERILTVSHENGKLQITFVTIAKVSSEPELRNLGDLKFMEKFEKECRALDRKKHDDEHRKRSGKQKEKRKVEDIDKKKEDEKLKQEEKKRNDEDKRPDKKDEFDGKYECVAVVNFFIIGVSRSWTFLNSICFVVISEPPKEKRQKSHHETKRNLEEQSHEDGIAPTSTTFVNGAVEGALSPCVSIDNHEDQQHDELDKRVYAQVGGVLGSPKPRSLESLLCVSKADLFLLGDEPRRSIQ

SEQ ID NO: 302 - protein, 100 aa, herpes simplex virus 6B
MRVFETETTQNARRVRQRTRTTVGSTDGAIGQQRVISGQNRGRARGRGRGRVPRRRNSNLNNLRTQNSAIVIDDSSETENFENAGSFNEDLLATTILETL

SEQ ID NO: 303 - protein, 113 aa, herpes simplex virus 6B
MFIWLFIVFFYAAYIGMAIGFIGSSPDAELSSENSRISSSVLLGCLLCCTDWSAVVPGKTETFRKPFVAIMIKKLKSCFAAYLSDLEQGSMCDMANASPTSLELGLSKLDKES

SEQ ID NO: 304 - protein, 114 aa, herpes simplex virus 6B
KICLFYVNVLIIYLHTFLKNGKITDGLFLDSVTSQPTKNKESRKKIEGKSPSWVQALTTASGIILLFCIMMIFITCSWTTEKDTEKSEVQSYASSVETLDSLNEAIIPKTEMNV

SEQ ID NO: 305 - protein, 1212 aa, herpes simplex virus 6B
MSSNLEDLLWQQILSMDPAELLSDNAISSTCDENIAAGHHFTQPPHVEMSVQSTTSAGHTGVMTTQSQFSNGVRDQNRESLSTLTGLSLESINNQINVQPTQMTFQPISPPMQGQNYVYSNNMINPIKPRSIIKSHGHSMGEMSFADHSLYVNAQPPVQQPQLKSLVGMHPCMTATSQGKYETNKTVGPPSISASQITTGNAGIRPGEYQSVHNQSSGNGSKSYEITTASGDEWILTTPGGQSWTLKRNPPNPPNNRTNSVVNKAQQVSHAQPYVSGSSDGFYQGAALQSCAYVNTPGFTPVCETQNMNNSQATQLSASMNCINALSTTMDAIVTSTSKPVGVVSNNRGANFGMGGMENYMDNNSPWNQYCKVQDIVSQNCSQGKVVSSTPGIAPNLMKGNGLNVYGHVGCVDAAISDKQGGTANVASSLLNPEHQDWMRVTGTSTNLLNNINAETKMENYGFPENGNVHGAVNTALPLTLSSGQPYTSVPQHGACEGNGTIPVVQICSPNTAFKAHYSLLGTVDENNPLSVRESIQDTSFSNGCAPQLSSPGGNPTIIAHSMIGNNGTPNKDVCKPTPSLRAIKKLNFDYDDRGENIGFPSKLAALLSMGENMSKMDNPCYGTSLAQFEESHQQNASEGKISIADLEFSEEDDVLSSAASVSCNDNCVMKIGLQQQGTTVADLQQGFKQQMNGEFSMFAVDENIKTQEMSNDCATNVTDNVCAIRQNKRMHCEIGISEDGRVREEEKCSDVAIHVPRKSARIHNMKSEGVTCGMCVTAADSTRQDASGGSSSGTKKGEKLQGLWKGYQDDDDSELTELSDTDSDNDVQNCHGVRKTGSKTYSSVFFNPDYRQAKRLLADIPYRRWIPDTFNMEEHEGPFLPIVTRPPTVFIGGRRRRTYLRRSVTSIGPLSKLTYFKELLQSYVLRNSNCYLSIGWPAKHRVYIMSEEKLGYNHIPTLREMFPLPPGWMIVLGIVGSETPAALYKHMVVLLCENKWVLLHNYRDSKHELYFAASDLKQFMEEGLSRCDCIYYEKSVPYGVAMEDSVREFLRNSKTFQSLMEYRKNMHGFTWTFNGMPGRLGDRVIHICNPELVNSIPADEAIRYEGKPLYFFAFVTTFKSHPGSKANVLIAADKNLGIYGYHKGRPRIRYLCKNVQAFFRAGVRKMYLDYEIPSKTLLAVSKDDYLCTLQKAPCLLLKPAVFRKTFSQEGK

SEQ ID NO: 306 - protein, 88 aa, herpes simplex virus 6B; identical to SEQ ID NO: 273

SEQ ID NO: 307 - protein, 647 aa, herpes simplex virus 6B; identical to SEQ ID NO: 274

SEQ ID NO: 308 - protein, 103 aa, herpes simplex virus 6B; identical to SEQ ID NO: 275

SEQ ID NO: 309 - protein, 212 aa, herpes simplex virus 6B; identical to SEQ ID NO: 276

SEQ ID NO: 310 - DNA, 1139 bp, herpes simplex virus 6B
  CDS (1)..(33)
  CDS (111)..(1136)
atggacactgtcattgagctgtccaaactcctggtaagtctccagagatcattgttaccgaatattttattgtagcgtaccatgacaataacattcaatatctttaatagcacgatgaagagttcaaagacaacgcttcctgtacctcgacccccacgctaaagacagcacgaatcattgagagcgcagttaccggaatcacgctcactgcatccgtacccatgatcattatagtgattaccaccatgattctctatcacagagtcgcaaaacataacgctacttcattttacgtcatcacactctttgctagcgattttgtgctcatgtggtgtgtcttttttatgacagtgaacagagagcagctgttctcatttaaccgtttcttctgccagttagtttacttcatctatcatgcagtctgttcatatagcataagcatgctagctataatcgcaacaattaggtacaaaactttgcaccggcgtaagcagaccgaaagtaaaacatatagcacggggcgaaacataggaattctcctactagcttcctcaatgtgcgcgattcccaccgctctctttgtgcagattaacggagcaaaaaaaacgacgggaaaatgcgtcgtttatctatcctctccgaaagcttacgaactgtttctagcggtgaaaattgttttcagcttcatttggggagtcctcccaaccatggtgttcagcttcttctactttatcttttgcaaagctttgcacggcgtcaccaagaaaaaacacaaaaagactctattttttattagtatccttctcctgtcatttttactcatacagatcccctatatagctatccttatatctgaaatcgcatttctctacatgccacagaacacctgcttttggttagcccgtgcagagatattgcagttaatcattcgattaatgccacaggtacattgtttctctaatccgttagtctacgcattcactggaggcgaactaagaaaccgatttaccacctgtttccaatgtccattttttcccaaaagactatgtagtacacagaatcgcaaacagtcagacgtctccgaacatgatcagaactcgccatcagaatcgtcagtggatgaaaacgaacccccttaa

SEQ ID NO: 311 - protein, 353 aa, herpes simplex virus 6B
MDTVIELSKLLHDEEFKDNASCTSTPTLKTARIIESAVTGITLTASVPMIIIVITTMILYHRVAKHNATSFYVITLFASDFVLMWCVFFMTVNREQLFSFNRFFCQLVYFIYHAVCSYSISMLAIIATIRYKTLHRRKQTESKTYSTGRNIGILLLASSMCAIPTALFVQINGAKKTTGKCVVYLSSPKAYELFLAVKIVFSFIWGVLPTMVFSFFYFIFCKALHGVTKKKHKKTLFFISILLLSFLLIQIPYIAILISEIAFLYMPQNTCFWLARAEILQLIIRLMPQVHCFSNPLVYAFTGGELRNRFTTCFQCPFFPKRLCSTQNRKQSDVSEHDQNSPSESSVDENEPP

SEQ ID NO: 312 - DNA, 1668 bp, herpes simplex virus 6B
  CDS (1)..(1668)
atggcgcagtgcaatctcttttatcaatacccaattacaccaattttagaagggcatgtcagaaacatactgatttgtacagaagaagatatcagaaggcttcaaagtcagtcctcactaagacttcgggagaaaatagatcaagggcatcgcgacaagttgctaagaatgcgcctaaaaaccgaattagacgcactgcaaagaaagatgcaaaaagacagtgacgttttgaattctcatttaaaagcgatagaggatgctttgctgtttacgaatgatggggaggtaaacgtcgaaacgaaagctgatacgcaactgttaccgaaatctcctgagaggctggaaaaatttaatcaagttgccataaccccactcgacccctttataagatttacagacgattttagaggagaaatgatcaatacttttttcaataatgctcagatgtggaattttacgttcgggtcttggttttataagctcaagagggttttttacaatgagcctggcttaagaagggctttaaaaattactaatgtggattctttgactatttcgaaagagttattaacagttaccgtcaatgcgttggagcaagcgacggtgtatcctatattcggaagtgagatgtcagacctggaagcagccttgtgtatcctggcagctttttattccacttatgagaattcacagatcgacgaacgtacaaccctagtagatattataacccttctgcccgtgatatttagattactcggtagtgaaattacagcattgaaaaatgtctctccttctggcacctattttggatttaatgatccttcttgtatgaaattttttgttcccatgagaaaaggcaagcattatgcagaaaacacatttgggaatcatgtgcttgtaaagatgttgctaggtagaggagtgatgcaaaaaattcccggtgagaaagacagccaaaattttgatgttgaagctcgcttacacggagccattaagaatgatgttctggtgtattggacgtatcagctaatgagaccaaaattgggaaataatgttccaatctttatacacgatcaacattatttacggtctggcttggttgcaattgaaagtctctttttattgtggcggatcttgaactcagaaagtttgtttaacaagagagttgggaagtttctcctgacttcgatttttccacagctggagaatgttgatttcgccgaaaataactttgaagctgggaatattcaaaattttgaatacttaatgcaccattacgttgtgcctatgtacaacctgcagaatgacatatcaatttcgactctttttcccggtctcgtggccgtgtgtgtaaatgagagtgtgagattgggatgggaacataagtgtgcaggggctccgtccgatgccgttcaggttcaatctaaagaaaatccgttcgtggagtatatccgcgcacaaatggaacaacaggcggatgtggctatacttgaaaagcatgactgcattctctttcattttgaaaacggtttaaacattactctatcttttacattaccgagacagagattgtttgcaatggcctcttcattatttaatgtaaatgatacttatgatttcatctattttctagttttaggttttctgccaataccggccattatataa

SEQ ID NO: 313 - protein, 555 aa, herpes simplex virus 6B
MAQCNLFYQYPITPILEGHVRNILICTEEDIRRLQSQSSLRLREKIDQGHRDKLLRMRLKTELDALQRKMQKDSDVLNSHLKAIEDALLFTNDGEVNVETKADTQLLPKSPERLEKFNQVAITPLDPFIRFTDDFRGEMINTFFNNAQMWNFTFGSWFYKLKRVFYNEPGLRRALKITNVDSLTISKELLTVTVNALEQATVYPIFGSEMSDLEAALCILAAFYSTYENSQIDERTTLVDIITLLPVIFRLLGSEITALKNVSPSGTYFGFNDPSCMKFFVPMRKGKHYAENTFGNHVLVKMLLGRGVMQKIPGEKDSQNFDVEARLHGAIKNDVLVYWTYQLMRPKLGNNVPIFIHDQHYLRSGLVAIESLFLLWRILNSESLFNKRVGKFLLTSIFPQLENVDFAENNFEAGNIQNFEYLMHHYVVPMYNLQNDISISTLFPGLVAVCVNESVRLGWEHKCAGAPSDAVQVQSKENPFVEYIRAQMEQQADVAILEKHDCILFHFENGLNITLSFTLPRQRLFAMASSLFNVNDTYDFIYFLVLGFLPIPAII

SEQ ID NO: 314 - DNA, 657 bp, herpes simplex virus 6B
  CDS (1)..(657)
atggagatggcgttcccgcgaaaatacgacagggtaacgggcagaatattgacacataagaataaccagatgtgcacaaccgaatgttctcagatgtataatttacataatcctatcacgtttgagttgggacttggaaacgtgtttgtctgtatgcggtgtttgacggttcaccactgtgatatgcaaactgactgtaccattgtcaacacgcatgaggggtatgtctgtgcgaaaacgggtttattttatagcggttggatgcctacatatgccgactgtttcttagaaccaatctgtgagccgaatatcgaaacggttaatgtcgtggtggtattgttatcttatgtatatagttttctgatggaaaacaaggaacgatatgctgccattattgatagcattattaaagatggaaaatttataaaaaacgtggaagacgccgtgttttatacttttaatgctgtttttacgaactcaactttcaataagattcctttgacgacgataagtcggctttttgttcagttgattataggaggacacgctaaaggaacgatttatgacagtaatgtaattcgcgtcagtcgtcggaaacgagaagacagtttactaaaaaagatgagattggagtatggaaacgcacttatactatga

SEQ ID NO: 315 - protein, 218 aa, herpes simplex virus 6B
MEMAFPRKYDRVTGRILTHKNNQMCTTECSQMYNLHNPITFELGLGNVFVCMRCLTVHHCDMQTDCTIVNTHEGYVCAKTGLFYSGWMPTYADCFLEPICEPNIETVNVVVVLLSYVYSFLMENKERYAAIIDSIIKDGKFIKNVEDAVFYTFNAVFTNSTFNKIPLTTISRLFVQLIIGGHAKGTIYDSNVIRVSRRKREDSLLKKMRLEYGNALIL

SEQ ID NO: 316 - DNA, 1008 bp, herpes simplex virus 6B
  CDS (1)..(1008)
atggcgatatcgactttttcaattggcgatttgggttatcttagaaattttttgcagaatgaatgtaactggttcaggatttgtaaaaaaacattctatcgcgaatatcgcagcgttgcgacatcgtctcctatattttcgttgaagaataagcctaagaaatattgcatgcattgcgagatggtagtgctcaagcgaagtcatgaatttatgttcagccttgcggtaaacggcatacattttggacagtttttgaccggaataatgaaatttaagaagaaacaggttgcggaagggctctgttactatgtattggaattgggaagcataagccctgtggatttgagctttatcccaaaatataattctgactgtgttacaagcatgcattgtgttacaccggagcttatttatgaaaattgctctattgtgtgtcccgaagaggcaagtcgcctcacagtaaaagggcccggggacaataaattgattcctttaggtgggtgtggagtatggtgtctgaaaaatggtggcgatctgtatatctatgctttcgtactcgtttacgatctttacgtagcttgttatgacaaaaccatctttccatctctggcaaaaattgtttttgatatgatagcttgcgattccgaagattgcgtcttttgtaaagatcacaacaaacatgtatcgcaagccggacatattgtagggtgcgtctctaatcaagaaacctgtttttgctacacaccgtgtcaaaaaaaaatgactgatattaacaatccggagttaatctctttgctctgtgatcaggaaattaataagatagatattatgtatcccgagaaaaaagcaccgttatcacttgacattaattcttacgttcatgggtacatcggcgacgagccttgtgcgttaaaatgtgttaattggatgccaatcaggatcagctcagctctgagcaggctgattattttgtcatgtcctgtgtgtaagcgtgtggtaatggactaa

SEQ ID NO: 317 - protein, 335 aa, herpes simplex virus 6B
MAISTFSIGDLGYLRNFLQNECNWFRICKKTFYREYRSVATSSPIFSLKNKPKKYCMHCEMVVLKRSHEFMFSLAVNGIHFGQFLTGIMKFKKKQVAEGLCYYVLELGSISPVDLSFIPKYNSDCVTSMHCVTPELIYENCSIVCPEEASRLTVKGPGDNKLIPLGGCGVWCLKNGGDLYIYAFVLVYDLYVACYDKTIFPSLAKIVFDMIACDSEDCVFCKDHNKHVSQAGHIVGCVSNQETCFCYTPCQKKMTDINNPELISLLCDQEINKIDIMYPEKKAPLSLDINSYVHGYIGDEPCALKCVNWMPIRISSALSRLIILSCPVCKRVVMD

SEQ ID NO: 318 - DNA, 345 bp, herpes simplex virus 6B
  CDS (1)..(345)
atgtctttgaaggactatctgagacagtcaatttctaaagatttggaggtgagacatcgagattctttaaagattagattaggggagagacatccgttgagtgtgcatcagcatatgatcgccgctaggcagatcattaaatcggacaatgcggaacaccagcatgtcatatcttctttgagtggttttttggataagcagaagagttttttaaaagtgcaacaaagagctttaaagcagctagagaaattggacgtcgatgaaataattgatacgacggcggaagtgaaagcggtcagtaataatataaaagaaactcttatggcaagcactgaattagaataa

SEQ ID NO: 319 - protein, 114 aa, herpes simplex virus 6B
MSLKDYLRQSISKDLEVRHRDSLKIRLGERHPLSVHQHMIAARQIIKSDNAEHQHVISSLSGFLDKQKSFLKVQQRALKQLEKLDVDEIIDTTAEVKAVSNNIKETLMASTELE

SEQ ID NO: 320 - DNA, 246 bp, herpes simplex virus 6B
  CDS (1)..(246)
atgggcacaaagtgctgtaaaccagtatcttgcggcatgtgtaagaaaaccgaaaacaccctgatggattacaagggaaatcctatattactgacgacggaatttactgttttgaccgataccgaatcggaagaggaagggatggcagatcttgaaaagcccctgcttgaaagagtacaggccacattagctgctaaatgtgatacggaagttgaaaaaaaactgccgcttaaatcaaaaaaatga

SEQ ID NO: 321 - protein, 81 aa, herpes simplex virus 6B
MGTKCCKPVSCGMCKKTENTLMDYKGNPILLTTEFTVLTDTESEEEGMADLEKPLLERVQATLAAKCDTEVEKKLPLKSKK

SEQ ID NO: 322 - DNA, 1989 bp, herpes simplex virus 6B
  CDS (1)..(1989)
atgcatctccgggggtgtgcgtgtcatcttagcctttattgtgtgtacaacgactgggagaataagatctacagagtaccgatttttcagtgtttgtttttagaagcggagactcgttcgttaaaaacgtttttgattaggggacagagcctagaccaagaatcgttaaatgagatagaagttacaagaaaagaaacaatgctttgggaccttcaggaacaaagtaatatgatggacaaaaaaatagcagcaatcagcagcctcattatgaataacggagagcttcttaggaaactttcaaaatttttcgtgcctctaactgttgttcttggagacgacgggttagagattttggaagcatacgtctgtggcgaggaacccatgctgcctttggacacggtacctgttatattacgatgtgtcggagactacgcagccttggacaccaagcatctcttgagtaacgaatgtacacaggcgtctaaaaaacttcgctttggatacagtgtaatggactttcacttttcgctaactgtgtctgatgtaaaaatttgcttttcacacacggacaccggtgaggctgtatgtgaaaaaatgaaacaaattttttatttttctgtgtgtgcttttggtggtgagcaagttctcttagtgacgccaaaaaatgcttatgccttattgttcgacgatgatttgtgtttgcttttactgcagagcgtgtttgctttcctgcacgagaagatattcggagtttataaacaggtgttagttcagctttgcgaatacatcggtcccgacttatggccctttgggaatgaaagatcggtttcttttataggatatccgaatctgtggcttttgtctgtatcggacttagaaaggcgggttccggatacaacttatatctgccgtgaaattctctcattttgcggtttggcgcctatcctgggacctcgtggtagacacgcgatccccgtaattagggagctaagtgttgaaatgcctggaagtgaaacctctttgcaacgtttcaggttcaatagtcagtatgtttcaagtgagtctctgtgttttcagacaggtcccgaggacacacatctattctttagtgacagtgatatgtatgtagtgactttgccagattgtctgaggctattattgaagtccacggttcctagggcctttctgccatgttttgatgaaaacgccacggaaatcgaactgcttttaaaatttatgtcgaggctgcaacacagatcgtacgctttattcgatgcggtgatctttatgttagatgcttttgtttccgcttttcagcgagcatgtactctaatggaaatgcgatggctgttagtgagggacttacacgtgttttatttaacctgtgacggtaaagattcacatgttgtcatgcctttactgcaaacggccgttgaaaactgttgggaaaaaattacggaaatcaagcaaagacctgcatttcagtgtatggaaatttcgcgctgtggatttgtcttctacgctagattttttttaagcagtgggttgtcacaatctaaagaagcgcactggacagtaacggcaagtaaatatttatctgcatgtattcgggccaataagacaggtctttgctttgccagtataactgtttattttcaggatatgatgtgtgtttttatagctaataggtataatgtttcttattggatcgaagagttcgatcctaatgattattgcctggaatatcatgaaggacttctggactgcagtagatatacggccgtgatgtctgaagatggacagcttgtcagacaagcacgtggaattgcattgactgacaaaataaacttttcttattacattctcgttacattgagagtgttgaggagatgggtggagagtaaatttgaagacgttgaacagacagagtttattaggtgggaaaacaggatgctctatgaacacattcatttgctacatttgaattaa

SEQ ID NO: 323 - protein, 662 aa, herpes simplex virus 6B
MHLRGCACHLSLYCVYNDWENKIYRVPIFQCLFLEAETRSLKTFLIRGQSLDQESLNEIEVTRKETMLWDLQEQSNMMDKKIAAISSLIMNNGELLRKLSKFFVPLTVVLGDDGLEILEAYVCGEEPMLPLDTVPVILRCVGDYAALDTKHLLSNECTQASKKLRFGYSVMDFHFSLTVSDVKICFSHTDTGEAVCEKMKQIFYFSVCAFGGEQVLLVTPKNAYALLFDDDLCLLLLQSVFAFLHEKIFGVYKQVLVQLCEYIGPDLWPFGNERSVSFIGYPNLWLLSVSDLERRVPDTTYICREILSFCGLAPILGPRGRHAIPVIRELSVEMPGSETSLQRFRFNSQYVSSESLCFQTGPEDTHLFFSDSDMYVVTLPDCLRLLLKSTVPRAFLPCFDENATEIELLLKFMSRLQHRSYALFDAVIFMLDAFVSAFQRACTLMEMRWLLVRDLHVFYLTCDGKDSHVVMPLLQTAVENCWEKITEIKQRPAFQCMEISRCGFVFYARFFLSSGLSQSKEAHWTVTASKYLSACIRANKTGLCFASITVYFQDMMCVFIANRYNVSYWIEEFDPNDYCLEYHEGLLDCSRYTAVMSEDGQLVRQARGIALTDKINFSYYILVTLRVLRRWVESKFEDVEQTEFIRWENRMLYEHIHLLHLN

SEQ ID NO: 324 - DNA, 161573 bp, herpes simplex virus 6B
  CDS (826)..(1296)
  CDS (3000)..(3509)
  CDS (5212)..(5814)
  CDS (8167)..(8514)
  CDS (9656)..(10045)
  CDS (10178)..(10459)
  CDS (10704)..(11198)
  CDS (11661)..(11825)
  CDS (11923)..(12222)
  CDS (17419)..(18891)
  CDS (19219)..(20031)
  CDS (23489)..(23764)
  CDS (23890)..(26766)
  CDS (29857)..(34398)
  CDS (34536)..(35414)
  CDS (35442)..(36470)
  CDS (36993)..(37745)
  CDS (37821)..(38588)
  CDS (45119)..(47107)
  CDS (47818)..(48195)
  CDS (52112)..(53146)
  CDS (57955)..(58872)
  CDS (62194)..(63162)
  CDS (66538)..(70575)
  CDS (70577)..(71467)
  CDS (71468)..(72946)
  CDS (73024)..(74403)
  CDS (76231)..(76830)
  CDS (80391)..(82475)
  CDS (82741)..(84957)
  CDS (85467)..(86597)
  CDS (87280)..(89862)
  CDS (90087)..(91637)
  CDS (93000)..(96398)
  CDS (96406)..(98586)
  CDS (101032)..(104070)
  CDS (106364)..(106681)
  CDS (107479)..(108891)
  CDS (108893)..(109162)
  CDS (118263)..(119162)
  CDS (119185)..(121599)
  CDS (122804)..(123691)
  CDS (123799)..(124749)
  CDS (124958)..(125224)
  CDS (125349)..(126248)
  CDS (126781)..(128283)
  CDS (128286)..(129590)
  CDS (129813)..(130982)
  CDS (131247)..(132131)
  CDS (133311)..(133571)
  CDS (133971)..(134402)
  CDS (134683)..(135015)
  CDS (139197)..(141773)
  CDS (143533)..(144768)
  CDS (144772)..(145896)
  CDS (146241)..(147572)
  CDS (147691)..(149298)
  CDS (149523)..(150683)
  CDS (150806)..(152107)
  CDS (152767)..(153282)
  CDS (153868)..(154338)
  CDS (156042)..(156551)
  CDS (158254)..(158856)
  CDS (161209)..(161556)
cacgcgcctctcgcagtggcgcgcgttttggtgaaaaacacggcgcctcccatagaggcgcgcgcgcgcgcgttgggggatgggttagggttagggttagggttagggttagggttagggttagggttagggttagggttagggttagggttagggttagggttagggttagggttagggttagggttagggttagggttagggttagggttagggttagggttagggttagggttatagattgcgccagaggcttcccttggcgtcgtgccagaatagcaagggtccgagacgacggcacgtcgcgcgctatgccgttcctcattgactttacatctgccccccgtatgctccccgcctgcccgcccgcgactgccatagaggtggtgtgtgcgtgtctgcgtgtctgcgtgtgcacgcgcctgtgggagaaacgcggacagaagtgattacggaggggggggggtattgtggtagacggggtagggagggggtgaagggatgtttcctttgttagtattttgcagcgttgcttatttttttttcctagttgccatgctaggagtcggcctttgtcgtcggtccgcgtgactgtctgtcgcatgcacttccgtatacttttttttgcgccccggcacgtcccgttgattggattgccgccgcacgtgtattcaatgtcatggtctcctctttttttttttttcactgtctatctttgaacctgttatcgtcttcccgccaaggctatgtgtctccgccttttttattttttttacgccgttgattttccgcgttcgtctccaaccccagaccgacctcgtgtgtatgttggctcctcccactccccggggcgtctatataaaaggcgaatgtggcgcgctttcaagcagtcccgatctatgcgactcaccgtgtcgcgttggcatcgggcgctgctatagcaactccgctagagggcggcggtgtctcacggacaggaagtatgttttttttttgttatgtggtgtcagtaacacggaacgtaagcacattgtgtgtgattgtgtacattcgccgattttatttctcatcgggttaaaggcagggagggatacggtcacgcgcacatatacacaccccacacatacacgcaggcggatagacatctccaccgcggttctgctttttcttttcttgcgtttgcgcactcctcacttttttttttttgttttatatttcgagatccttgtcatgatcttcctccggtcatgtctctggccgtatatcgcatccttacgtctccgccgtggcgtctaatccaggtacgctctttgccggggaagttttccgaccggcggtctcacgtgttcacaggagtggccaagcgttcccggggagatgtctacccggggccgaatacgtccaatgtcctctcatggcccgcggcccatcctccacagggcggcgaacgagttcgccagacggcagatcttgccgttatcgggccagaacgataacagcggtcccgccaggtgacgatcacccaagccgtctccacttcgcgtggccccggcgtgggcacgtttcccagagtcacgcctccgctgcctatcggaggcgacggcgtctgcgtctccctctctcgagacagaacggcgcacactatccacggtcccagggggtgtcccgcgtacaggtgcaggcggagctgtctccgggcatcgggccacaagcgatactgagcccgcgccacggtcagagtcatgcgtacgcccggaaccgccgtccacggatctcgcacggtctctagtaattcacagctcactccggcgtgcgtttgacacaggccgccgacggtcagcaggtcgtgttcgtcggcggccgcggcgatcacgtcgaacagatgtctgacgttcgttccgcacatacgccggtccggcagctctaggtcctcctcatacgccacggggtcccgctgcagccctcgccttgcaaactccgttacgttcgacgccagtcggcagagtctggccgccctcatgtggtggacgtacacggctccgtctctaccgaccaggagcacgcgaagcgtgtcgagcggggagtgggtcagatacgagcttacgaagcccacgggttgaagtttttctccgtatccgcaacatacgtacagactcgagtccagggctggggcgggacacgcgtacgagaaggatcgaggatgaccgttccggccgataccgtagaagaatcataaaacatgaaaacgcaaaacacagagaaaaatgcacgttatagtgggcgttccgctattttcgtctcttgtctctgttcctataaaacagcagaaaacatccgcacacgcaaaggcatcccatcggccggacgtcacgactggcgtcccgggaactcgcgtttctgcgcgaacgggagatgccgcatagagtcatcgtagggatgcctttgcggcgtgtaacgcattcgtatcctgtcgcgtaccgttaacgcgaaaagcatacgcaacagcaatggcgactactaactcaacgcgataacacagaggaaaggaggagctttactgtttcctcttttttttttatttttttaaccgttgtgtgtacgtcgccgacgtacgttttatacggaacctaaaaaaaagcggtctcctgtacactatgcaggatatccgtaatcatcgtgttccggaagtcataccgcctgtaccgtccttaacggaaagtacctttgcggggaatttacgtataccgcattaccgatgaatacaaaaaaaaaaaacaatgtctggaggaaactccgtgagtcgtctgtgaggccggaggccgtggcaggcgttgccggctgacggtcacgcgtgtcacagacttcaccatgtttccttccccccccccccccccgtgtatccgtactcgttttccgtaactcgcgctttgacggtctgcgcaccctatatttctccgcccctgacgtgacgttgttttgtccccactctccgccagccaatgtcttcggtggttttcgacgaaccctccacccactcaccctccacccgctcgccctccacccgctcgccctccacccgctcgccctccacccgctcggcctccacccgctcgccctccacccgctcgccctgcggccgacgtccctccccgccgctcgcccgtgtgcgcatagcgtcgtcggtcgcggcggcgctcactcaccgcagtcttgaacggatctgggtctcacgtgcgttggcggccaaccccagcggtgaccccacacggtggcgctcctggcgtccctgtacggatccggatggagttctaggcaccagtaccgcggccacggtaggtggatccgttctccccggtgccgactcgtatagccgtacagtttggacggcctgccgcgagccaggagcagccactcgaagcgggcacgggctcgcgcgtgggccaatcgcgccccgtcgcgccggatcgcgatgcgtccgtccctcatctgcgtgtgtcgcgttgtcataacccccgattcgtgtgtgaatcacggacgggtttttattttcgtccgcccttggcttcctatgtggaccggggcctctctcttactgtatttatcttatttttgctgtccgctgtagctcttgttgtgaccaacgaccgttgtcatccgcggtcgagtatagtcagtgtcgatacggcaaggtgtttgatggtctgtgatggggaggggtggagagataaaaaaacatgtatacggtgtagtcagtaacactcttggtggtggagcggctcagtgaaaaataaaagaaagagaacgctgtgagcggagatgaaccatagaatcgcggaactaccgcgcggttgaacggtgacgacggaccgcggtgttctgtgcggaaccgacaccgcaacgccctggcagaaccgcgtctgcggaccccgatgtaaacgggcgaatccgccgcgtgccgcatctccgggaatcaccggggacgtcacgtggaaacatttttaacaacaaaattcgttttatttatgtgtctttcgtttttcccaccgggtgtgtcgggggatgagggcggggggaagggcatgaggacgagggcgggcccgggcaaatagtctcgcgataattcgggaccccgcgtttacttctcgctctttatgcccgcatgcgtcggggtctcgtttcgccttcgttgccgcggcagggtcggcgccagcccatcgcgaactcgggggacgggggtgtggcgccgactctgccgcgttgcggtttcggggcgaggggatgcgtcctataggcgcgcacgcggaaggccgggcgtataggaagggtggcgcgtcgcgaagtcccgcctcataggtggggcattcgaggccgccctctatactttcggtttcaggtacagttttgtgattaggtctcgggctacctgtggattgggagggccggagtctcccggcgtgtctccgtttatggagaggtcgggtccgccatttattgaaaggggacgtacggagaaggatgcacgtttagtcagtgtttagcctttattttcattttttttttatttttaatttccacatagtattttttttttatttacaacaaaatttaacttgttttattcggtactctttcactatggcgatgatctgagagcatcggtagtccccgtcgtcgcctccccgggtgctccgccacgactaccgtgacggcgacagccgccgccgccgttactgtcactgttcaaagaacgtggccgttacagtttccgctgccgctgtggtcgccgcctctgcggagagagtcggcgtgtatgctccggggagggggatggagggaggggggggggggaccgagggggcgtgggaggagcgttgccgtggaggcgttcgggggactgcccgccgacgcgcctgcgcgattcgagtgggggtgagagggacggtgaacgggccggcgagcgtttgcttgtggtggtgtgtttttttttgtcatcggttgcatctgtgtgaactggcacgagtcagatgatttttttttatcggggcggatcgggcggggggcgcggagcggatccggccctcaggtgactccgcagactggcgtgtggaccgtacccagggaggaaggatagcaggagtcggtcgatcgtctcgctccgcttggttttccgtgtcacggcgcgcgcatagactccgttaatttcggcggccgatgtctcgcgtgttctcgtgcgtgctccgcgcgtgtgtgtgcgccggcctctgctgctgggtgtgtatgggggtgatatgcggtgactgtcagcggtggtggcggaggaggtgcgcgaggtgggggcgtgtcggacctcgggtcctggacggaggggcgtggagggtccggagcggcgacggagtccgctcggtatcgcggacgtgcaaaaccgagcgggctccatccgccgctcggtctccggtgtattcccctcctttcgtcctcgtttcttcgtcttcttcgtcttcatgttcttctgcatgttcttctcgtgtcccttcgccgcctccgtcacctcacgcggcgtctcacgccgtctgtgcggagggcggccgcgacctgccgatgcacggcgcggacggagatgccgatgagggaacggacgggactcttttggaaaagggcggcgcggacgagggcgccggcgggaacgccacgggatgcccggaggacacccgcggctttgctcggagtcccggagatctaatgggggagatgaacggagatctgggagacgagggagagacgggagagggcggagacaacggggagggagagtaggacggggaggaggaggaagaggaggaggaggaggaggaggagagggaggagagggagaaacggacacgcgcggtggacggcgaggggacggacagagcggagaggcgcgggacagcggactgcggggcgtcgggcgacgggcagggcgggcacggagaacacttagagggttcctccgcgggacctggcgggcaccgagggcgggcggacggctcgtcttcgacgggcgttatcgacggcagcggggaagggaataacagatgaggaggagggacccacacgcggggatcgggcctggggacagacagggggatcgacgaccaggcaccatgttcgcctctcccgccgtacgtctgctttgccctcccgcagctccttccgctaccgccctgctccgttcccttctcgtctcttcttgcgacctcgctctcctgtgcgtcctcctcgcgcccggagtcggtctgttccccgtcctcgtgctctccgcgctgctggggctctgtttcgtcattcgcgtggcggcgcgcgccgtcatcgcggtgtcctcgtccgtccccgccgcgctggtcgccgtggccgctttcctggcgcccgtggtggccgtctgtctgttcctcagattcgggatgtgcggagaaagggacgtccccggttgtcacacgtcccttctccgtcacccccctcggacgggtcggtctgcgcggcgacgtcgcggccgtcgcgctcgccgtcgccgctctccctcttccctcttccttctcgtaccccggctttctcgccgcctcgccgctcccgctcgggggacggagaggaagccggagccctgagagcaggagcaggctccccaggcgcagcagcagctccaagtcgtccgcgatgcgccacagggaggtgtcgttcaggtcaagcgccaggacggggcctccctccgttaggatcagacagacgtgcggagatgccgtgagaaacgcaaagggaagccagccgccctccccgcacagttcgtccagcagcggtctgcacctcgcaaagtcttccgcggcgctgggctcctcaccctgaagggaccgaccggagtcgcggaggccccgcgtcaggtgcggacttgcgagtctgtcagtggcttgctgtcgcccgcctctctccgcctcctcttttccccccgccgccttctctgtcgctgcgttccatgtgtctccggcgtcactcgaggaaacgcgctggaactccgagccggacaggaggtgcgtacacggccacctgcgtctccgatccgtcaggaccagctctgttctctcccactccaacacggggtgagagagctccgagcgggatcccagatgcagtctccacagggcatagaaagcggccaggccgcgtcgggcggttctcgccagtaatttcggcaagaaggccgtgtcgggatctcgacacgtccataggctcggcaggggccgtacgcgccacagcggtgcgcgatagatggcctcacactggcgaaggcccgtctttagaaagagcgacacggagtgcgacaggagatagagtcggccttggaacacgtcgtggcagaacagagaccctcctggcgcttgtaggagcacgagccaaggggacgatcccgttaaccaactgagagacggatgtgccgcgtggaagccgctgcagtgtgtcggctcagaaacgcgcatggaaaaggcggacagcgtgatcaggcccagcggtagcaacttgctgtcggccgaagatggtagggtttagggtcgaaccctgagaccgagagaatagagacaaatgtataaaagagaaaccgaaatgtgcttggtgtagcagacaaaacacaataaatcatgtgaacaagtggaagtgtaaatgtcactcacatagagaagaatccgcgggccagccctgaagaagatgcggttgtcttgttagacaagggtaacgcaggagaaacttgtaaggcttaggatgtaaatgcaggcattcttgctcgggccaaggtaaaggaaggcgtagacctttgtgcaggcgaaggtaggaatggacatgacgaagggagtgtcgacccaacagtagccaccaatagtgggacagcggaagacgatgcagggcgtggctgacacgcgccggcagcggcatcctagaaaacaggagtaagaatagaggggcggagaagtgtagagagaagtggggcgagatggagggaaaaggtgaagttcagaggtggtggtagcggtggcggtgtgtgtgtgtgtgtgtgtgtgtgggggggggcagcgggtggggtgatggtgagtggttgaaagaggggtagtgttagggccagatgcgaggattagtgttagggctatggttagggctagggttagggctatggttagtgctatggttagggctatggttagggctatggttagggttatggttagggctatggttagggctatggttagggctatggttagacctagggttagggttacggttagacctagggttagggttagggttagggttaggcctagggttagggttagggttagggttagacctagggttagggttagggttagggttagacctagggttagggttagggttagggttagacctagggttagggttagggttaggcctagggttagggttagggttaatacccccctttttttaacccccccggggagtttaaagtaatttttgaaacgcgaggatatctgtcttccagagcaacagtatcgcacaaaaaagtgtcccggcccgagcgcagtccggcttcccgatgcagagaaagcagcgcctgtatgggaataagtgtcccggcccgagcgcagtccgacctcccaaagcagagaaggcagcgcctgtatgggaataagtgtcccggcccgagcgcagtccggcttcccgatgcagagaaagcagcgcctgtatgggaataagtgtcccggcccgagcgcagtccgacctcccaaagcagagaaggcagcgcctgtatgggaataagtgtcccggcccgggcgcagtccgacttcccgatgcagagaaagcagcgcctgtatgggaataagtatcccggcccgagcgcagtccgacctcccaaagcagagaaggcagcgcctgtatgggaataagtgtcccggcccgagcgcagcccagctccccggagcagacagacaacgcctgtatgaaaagaagtggcccgaccggagtgcggttcagctgcggggtgaaaataagacacccgagaagccgctacaaacgcgcgggtacgcgtgtgatcaagacttaatatctgaccaccaaaactaaagtctacacacacgccggttacggaagaaatcaccgacaaactactgatcgccaaatgacgatcagatgtatttcttcctcgttatcgattcataccacccccccccccgttttatatcgtcgcagataaaaatgatcgccccagacttatctccgagtacgctccccgacgacgatacaccgcacgatctttccacccacgtatgattttacaaggcagagattgaagactacgtgtctcagtcacacacggtaaacgagtgtgaacgcgccagacgttgctcgttagccatatatcatctttgggaagtctctagttgcattaatttcttgtggctttacattcacgcgaatgttcccggatgcaaaccgctctattatgctctcccgtcctcgtaggatttgtctcccgtttctcctcctgtagatcttatctaacaccatcttcctttctgtcctcttcctcccgcggatacgcattttcgcaagactaagacggagaacggcgaccgcaacgctaagcgctatgagaccgccgagatgttctgcgccgatactcgtgtgcgcgatttccatggcgacagccctgtcgaatgctacggtctaccgagatgcgggaaccgtggaatccacaccgccgccggacgacgaagacaactataccgcaaaatactatgacgacagcatttattttaacatttacgacggtacaaatcctacgcccagaagacgaacgctacccgaaatcatctctaaattttctacctccgaaatgtcacgtctaggaggccttaaagtttttgtccccgtagattataccccaactactaccttagaagatatagaagacctcctgaactacgccatttgcgatgataacagctgcggttgtctcatagagacagaggcacggtaaggatctagcgttttattttatttcgtcttgtttatttgccacgcgctcattctcccggacaccgatgtcggaatccgccgagataacaaataaatgaatatataataatcatagttaattccccgcagcatcatgttcggagatatcataatctgcgttcctctctcggccgaaagcagaggagtgagaaatttgaaaaacagattaatgcctatgggtctatcacagattctctctagcggcctcggccttcacttctctctgctatatggcgctttcgggagcaactataatagtttggcctatatggagcgcctgaaaccactaaccgcgatgacggcgatagctttttgtccaatgactagtaaattggagctacgccaaaactacagactggaaaaggctcgatggtgagtacttgtacaagtttttgtgccttcccgccacgtctcctttatcgacaaggaaaggcatgcattgtgtatttattcacatagaaaagcgtaagatccccgccgtataaatatcccgaattcactaaaaagagtcccatttatacaccccgccccgccctcggatgcacctgtcactctaaaaatgtcgcagcacttctcctccaccctccactccaccccctcttagaagacagaccacacccatgtacgcgcatacgtgtcaaccccacacgcatacctacatcctttcagagcagaaactatggggctggaagcttcgtaacaagaaaattttttctcgttccttgtatcttgcctctttgtgcggcacacatgtattcatccactcaaaatccagcgaactgatcgtcaatatcgaactcttgaagatacaaaaccatggcggacagactatcaaaacgttaacctcgtttgcgatcgttcgaaaagacaacgacgggcaagattgggaaacctgcacgcgcttcgcgtccgttagcatagaggacatattgaagtctaaacctgccgccaatggcacatgttgtcctccccgagacgtgcaccatgatcgtcctacgttacaatcttctaactcatggactcggactgagtatttcgaaccgtggcaggacgtcgttgacgcatacgtccctataaacgataatcattgtccaaacgatagctacgtcgtgtgagtgattcatgctaattttttaaaaaaaaaactacatctatgttttttattggttttgccatatagcagtggaacacaattctgaaattctaatttggaaattcgctttttttgtcagatttcaaaccctgcaaggtcacgaatggtgttcacgtttgaataagaacgacacgaagaattatttatcttccgtactgtaagtaagcttattttctcttctttgaacgtgagttcgagtttatactatctgcgatgtatcgtttgaaagagtttatatttgagatttcttaacttgtgtttctcacagagcgtttaaaaatgcactgtacgaaactgaggaactgatggaaaccatcggaatgcgacttgcctcacaaatattgtcactggtcggacagcgaggaacatctatacggtgagtttaaataataggggattgataggaacgaattttttttagtaacctgttatatttatttttttttttttttttgctttttcggttatgcacagcaacatagatccggccatcgtaagcgcattgtggcactctttgccagaaaaactgacaacgactaatattaaatacgatatagccagtccgacccatatgagtcccgcattatggtgagcgctgttaaactatcaatctgtatgtagagttttttttttacgtttaatttcactttctttggattagaagacgaaaggccataattaaacaaatgacttttcccgagtttttttttatatttatgcagtttttcttaatccgcagcaccatctttgtacagaccggaacttcaaaacaacgtttcagaaatgcgggactactgatggttaacaacatcttcactgtccaagcgagatatagtaaacaaaatatgttcgaaaaaaaaatatatggatatgaacacctcggacaagctttatgcgagggtgggcacgtattttacaacccgagagatgtatactttcagaacatcaaaatggcagctacagaacctactgtcgtgagaacctgaccgttatttgtgcgtgtttggatgtacacggcctcggacttctatattttcctgtgatgtttacatgtagacttgtacactttatcgatgtagataacgataactcccgataaacctctgttttttggaacacatgtaatagtgcgttaacgaccatgtgtatagtcgattgtatatttagttgtaaatattcatactatatttaaatgaacataaaaaaacattgtttaaataacaaactattgctgctagataattatgcatttcgtggctgtgtatattttaacacatttccatgcatatcctggagtggctgcgctaccgttttttagcacgttaccgaagattacttcgtgctgtgatcactatgtcgttcttaattcactgagttctgtatcttcctcgactccgacctgcctagacggtgaaatgtaagtgtcgttctatctactcggggaaaatgtcaccacgggtaaacttgaatgattagtacaccattttctcgtgtgtgcgtgtatgtggatgtatacgcgtatagtctgcgtaataacacaggacatcgccggttaatctataacttgatatttgttcagtctgtttcaaaatgcaggccagaaattttgtcgacctttcacggacaatagaacaattgtatatactatgcaagaccaagtccaaagaccctggtccgtaacatggatggatttcaatctagtcattaggtattaattcacatgcgaatcattttatttccactatgtttgtttctttgttttcatccgtacttatataaattgcaggtaggcctactataaaatttcatatgtctttttttttgttttttttttaagtgactacgggagagctgtgatagaaaatttaaccgaaagtgctatgtcagcacacaaaaacgggccaagatatctgcagatggaaacgtttatatcggatttattccggtatgaatgtcatcgagataatcgttatgttttagaaaaaaaactacaaatgttttatccgactactcatatgaacgaattacttttttatccctcagaccctacgttgccctcaccttatggcaacggacattattaaaataaaaaaattactgaaagggagagtcagaaattgtgtcacatgttattttattaaatcttactgaactttgtcctttgtccttacaaaccttccctatcacaatacacagaaaaaaaaaacaaagagattagtacatagaatctctggtcattttgaaagaacagtttacctatcaacaatgtccaattaatcaacattaaaaatagcagaagtttacctagagattacaaggtacacaatacacagtagaccgagtattacgtatctctgataaatgtcaaagaaacagtaaatctcttagcggatggaatcaatggcctttctgttttaattaaaaaaagagggtgggaactgtcaaggaaaactcttgacatagcaattcttatttaccttcctgagagaaagtctttctaaacacagctggttttaagagcagacaaggagctttttgtagagtacacagatagtcatctttgctgacggcaagcaacgttttcgatggaatctcataatccaaatacatctttctaactccggctctaaaaaaagcctgtacgttcttgcacaagtaccgtatcctggggcgacctttatgatagccgtatatccctaagttcttatccgcagcgatcaatacgttggccttgctaccggggtgtgatttgaaagtggtgacaaatgcaaagaaatacaaaggttttccttcatatctgatggcctcgtctgctgggattgagttaaccaattcaggattgcagatatgtataactctgtcgcccagtctaccaggcattccgttaaaggtccaggtaaatccgtgcatattcttcctatactccataagactctgaaacgttttactgtttctcaagaactctcgaacagagtcttccatggccacgccgtacggcactgacttttcataatatatgcagtcacatctagacagaccctcctccataaactgtttcaaatccgaggcggcgaaatacagctcgtgtttagagtcccggtaattatgcagaagcacccatttattttcacacaggagaaccaccatgtgtttatacagagccgcgggcgtctctgaaccgacaattccaaggacaatcatccatccgggtggcagtggaaacatctccctcaaggtaggtatatgattataccccaatttctcctctgacatgatatacaccctgtgtttggcaggccaaccgatacttaaataacagttgctatttctcaacacgtagctctgcagtaattctttgaagtaagttaatttactcagaggaccgatagaggtgacacttcgccggaggtaagtcctccggcgtctaccgccaataaacacagtgggtggtctagtcactattggaaggaatggaccctcgtgttcttccatgttgaatgtgtccggaatccatcttctgtatggaatgtcggcaagcaatctcttggcttggcgatagtcaggattaaaaaatactgaggagtacgtcttggaaccggtctttcttactccgtgacagttttggacatcgttgtcgctgtctgtatccgacagttcggttaattccgaatcgtcgtcatcctggtatcccttccaaagtccttgcaacttttcgcctttcttggttccgctgctcgaacctccagacgcatcctgccgtgtggaatccgcagccgtcacacacataccgcaagtcacgccttcggacttcatgttatgaatacgcgcacttttccgcggaacgtgaattgcgacgtctgagcacttctcctcttcccgcacccggccatcctctgaaatcccaatttcacagtgcatacgtttattttgtcgaatggcgcatacattatccgtgacgtttgtcgcgcagtcattcgacatctcctgtgttttaatgttctcgtccactgcaaacatggagaattctccgttcatttgttgcttaaacccttgttgtaaatcagccacagtggtaccttgctgctgaagtccgatcttcatgacgcagttgtcattacagctgacagaggctgcactggaaagcacatcatcttcttcagaaaactctaaatccgcaatggatattttaccctccgatgcattctgctgatgtgattcctcgaactgcgctagagaagttccataacaaggattgtccatctttgacatgttttctcccatagacagaagggctgccagtttggaaggaaatcctatattttcccctcggtcatcatagtcaaagtttaatttttttattgcacgtaggctgggggtaggcttgcatacatctttattcggggttccgttatttccaatcattgaatgtgcaattattgtcgggtttcctccaggcgaggacaactgaggagcacatccattactaaaacttgtgtcctgtatgctctctctgacggacaaggggttgttttcatccactgtaccgagcaaactgtagtgcgctttgaacgccgtattgggactgcagatctgtaccacgggaattgttccatttccttcacatgcgccatgttgtggcacagatgtgtagggctgaccactggatagagttagtggtaaagctgtattgacggctccgtggacattcccattttccggaaaaccatagttctccatttttgtttcagcatttatattgtttaacagatttgtgctcgtcccggtcacccgcatccaatcttgatgttccggattcaatagagaagatgcgacgttagcggtgccaccttgtttatcggaaatggccgcatctacacaccccacatggccataaacattcaacccgttgcccttcatcagattaggagcgattcccggtgtcgaagaaacaacttttccctgggagcagttttgagatacaatgtcttgaactttacagtattggttccatggactgttattatccatataattctccatgcctcccattccaaaattagcaccccgattatttgataccacccccaccggcttggaagtagaagtgacaatcgcatccatagtagttgataacgcatttatgcagttcatggatgcgcttagttgtgtcgcctgtgagttgttcatattctgtgtttcgcacacaggagtgaaacctggcgtatttacatacgcacatgattggagagcagccccctgatagaaaccgtcgctagacccagagacataaggttgggcatgcgagacctgttgtgccttgttgacaactgaattagttctgttattcggaggattaggggggttccgtttcagagtccaggattgcccgccgggtgtagtcagtatccattcatcgccggatgccgtggtgatctcataagacttagacccgtttccagaagattgattatggacagactgatattccccgggtcttataccggcatttcccgtagtaatttgggaagctgaaatagagggtggccccacagttttatttgtctcatatttaccctgtgaggtagcggtcatgcatggatgcatacctacaagggatttaagttgaggctgttggacaggcggttgagcattaacatacaaggaatggtctgcaaatgacatctcccccatcgaatgaccatgtgatttgataattgatctaggtttgatgggattgatcatattattgctatagacataattctgaccctgcatcggcggggaaatgggttgaaaggtcatctgagtgggttgaacattgatttgattgttgatgctttccagcgagaggcccgtcagagtcgacagtgattcgcggttttgatcccgtacgccattggaaaactgcgactgtgtcgtcatcactccagtatgacccgccgatgtcgttgattggactgacatttcaacgtgcggaggttgcgtaaaatgatgtccagctgcgatgttttcgtcacacgtggacgagattgcattgtccgacagaagttccgccggatccatactgagaatttgttgccataacaaatcttccagatttgaagacatctagaggtgacaagccaggggaattaccttattttccgtatacaactataaaaatcttggaaggcacaaacggtatgttttccataataaatccaagtgatgatttttggactaaagacaaatatatcatgttgactatcaaaggccccgtggagtgggaggcagaaatccctggaatatctacggattttttttgtaaattctctaacgtgcccgtgccacattttagagatatgcactcaccgggagcgcccgatattaaatggataactgcatgtaccaaaatgatcgatgtcatactcaattactggaataataaaactgccgtccccacccctgcaaagtggtacgctcaagcggagaataaagctggcagaccctccttaacattattgatagctttagatggaattcccaccgcaacgataggaaaacacacaacggaaatcaggggtgtattaattaaagatttcttcgacgggaacgcccctaaaatagatgattggtgcacgtatgccaaaacaaagaaaaatggtggcggaacacaggtcttcagtctaagttatatcccctttgcccttcttcaaattattagaccacagttccaatgggcatggacaaatattaacgaactgggagacgtatgcgatgaaatacatcgaaaacacatcatatcccatttcaataaaaaacctaatgttaaacttatgctgtttccaaaggatgggaccaacagaatatctttaaaatctaaatttctgggaaccatcgaatggctgtctgatcttggaatagtcacggaagacgcgtggatacgaagagacgttagatcatacatgcaattattgacactaacacacggggacgtgctaatccatagggctctatctatatctaaaaaaagaataagagcaactagaaaagctatcgattttatagcgcacatagacactgactttgaaatctatgaaaacccggtttaccagttgttctgtctgcagtcttttgaccctatattagcaggaaccatattatatcagtggctaagccacagaagagggaaaaaaaacaccgttagttttattggtccacccggatgtggaaaatcgatgttaacgggagccattcttgaaaatatcccgttacatggaatattacacggatctttgaatactaaaaatttaagagcttacggacaggttttagtcttgtggtggaaagacataagtatcaactttgaaaattttaatattataaaatccctccttgggggtcaaaaaataatattcccaattaatgaaaacgaccacgtacagataggaccgtgtcccatcatagccacatcttgcgttgatatacgctcgatggtacattcaaatatccacaaaataaatctatcacagagggtatataattttacatttgataaagttatccctcgcaattttcctgtaattcagaaagacgacataaatcaatttctgttctgggccagaaaccgttctataaattgttttattgactacacggttccaaaaattttataactatctatttaaaaacatcttaacagactacttttaaaataccgacaagaaaataaaaaaaaagacatcacattataagacgctgataactcaccctgtaccgctgtgtccaagctagcagaagaacagctaatggcgtatagcggcaaattgcctatcctataaatactgaagttaataggcgtggtaggaaatgatgattaatacatcattaaaatattctacttcacggcttttgattcgttattcgtaagtgggtacaatgaaaaaaaatcaacactgccttaatgtatgcaccctcaagagtgctgattggatagagatataatgatatataaaaaagtgcatgatgaacaaaaaagtttgtttttccataaatttaaatgtcagtgggtgccgcggttagggtctttcctacccaagcgggtgagaaccttaaaaattgctaacggggcaaccgcagcttctgtttttcatcaaaaagttaaaggtcagtgggtgccgcggttagggtctttcctacccaagcgggtgagaaccttaaaaattgctaacggggcaaccgcagcttctgtttttcatcaaaaagttaaaggtcagtgggtgccgcggttagggtctttcctacccaagcgggtgagaaccttaaaaattactaacggggcaaccgcagtttctgtttctcctcataaagttaaaggtcagtgggtgccgcggttagggtctttcctacccaagcgggtgagaaccttaaaaattgctaactgggcaaccgcagtttctgtttctcttcatacagttaaaggtcagtgggtgccgcggttagggtctttcctactcaagtgggtgaggaccctaaaatccgctaatggggcaaccgcagtttctgttttttctgataaagctaaagatcagtgggtaccgcggttgaaattttttttgcccatacggatgagaactctaaaagctgttaacaaagcaaccgcatttcctgtttttcctcataaacttaaaggtcagtgggaactgcggttgaagtctttcctgataatgaggatgagaactttaaaatctgctaacaaagcaacaaagttcctgtttttcttcataaagttaaagatcagtgggtaccgcggttgaagtatttcctgccaatacgaatgagaactctaaaagatgctaacaaagcaaccgcagttcctgtttttcctcataaacttaaaggttagtgggtactgcggtttaaatctttcctgctaataaggatgagaacttcaaaagtctcgtaacgcggcaaccgcagttcctgtttttctcagaaagttaaagatcagcgggtaccgcggttgaagtctttcctgttcatgcgaattaaaactctaaaagctgctaacggagcaaccgcagtttctgtttttctcataaagttaaaggttagtgggtactgcggttggggtctttcctacccaggctaacgagaaccctaaaatctgctaacggagcaaccgcaattcctgtttttctcataaagttaaaggttagtgggtaccgcggttgaagtctttcctgattatgcgaattaaaactctaaaacctgctaacggagcaaccgcagttcctgtttttctcataaagttaaaggttagtgggtactgcggttggggtctttcttacccaggctaacgagaaccctaaaacctgctaacggagcaaccgcagttcctgtttttctcataaagttaaaggttagtgggtactgcggttggggtctttcttacccaggctaacgagaaccctaaaacctgctaacggagcaaccgagttcctgtttttctcataaagttaaaggttagtgggtactgcggttggggtctttcctacccaggctaacgagaaccctaaaacctgctaacggagcaaccgcagttcctgtttttctcataaagttaaaggttagtgggtaccgcggttgaaatctttcctgctaataaggatgagaacttcaaaatctgctaatgggggaaaccgcaatttctgtttttctcataaagttaaagatcagtgggtaccgcggttggggtctttcctacctaggctaacgagaaccctaaaatctgctaacggagcaaccgcagttccagtttttctcataaaattaaaggttagtgggtaccgcggttgaaatctttcctgctaataaggatgagaacttcaaaatctcgtaacgcggcaaccgcagttcctgtttttctcataaagttaaagatcagcgggtaccgcggttgaagtatttcctgcccaggcgaatgagaactctaaaagctcgtaacgcggcaaccgagttcctgtttttcccataaagttaaagatcagcgggtaccgcggttgaagtatttcctgtccaggcgaatgagaactctaaaagctcgtaacgcggcaatcgcagttcctgtttttctcataaatttaaagatcagcgggtaccgcggttgaagtatttcctgcccaggcgaatgagaactctaaaagctcgtaacgcggcaaccgcagttcctgtttttcttataaagttaaaaattagcagatattgcggttgaagtctttcctgttcatgcgaattaaaactctaaaaactgctaacgaagcaaccgagttcctgtttttctcattaagttaaaggttagtgggtactgtggttggggtctttcctacccaggctaacgagaaccctaaaatctgctaacagagcaaccgcagttcctgtttttctcataaagttaaaggtcagtgtgtaccgcggttacaacattttcccctgactaagtcatttatttcgtgagaagcgctaacaccaaaaccacattcctgtttcatgatgtgtagcagatgtttttaaaaaaaaaacatgacaatttatcagtaaagtgttctttattatcccgccttcaaccgcaaactccgtctttctcataaaaaaatacaagtcagccataagaagaaaacctcaaaaaatccagaccacaaattcctgtttttgagtaagatatgacaaaaccctaaatttttgtaagcatcagctaatttccattccatatttgtctaaaaggggtgtatttctacacttgcggtttaacattatacagcgattggctccttcatcctcgtcattttcctgtacatcacacccgctatagaattgtatataagcagaagttacagccagttcagtgccacttttctcaagaagtggctccggagaacattctcatcacagagattctttcttatatcgctgcagtctggtaagtcaattttttaactattaatatttaaaattgctacaaaaattattttaaattgaatttaagaatgtttaaaacaatttaatgatattttcatgcgcataattgtaatttgataagcacgaaagaatttatactgttcacatttaatcttacagatttgtgacattgattacatcccatcaattattggattgctggattttcttcccgcccagaagaaagattgattgcacccgaaaccaccacctggaatcaatctccaaagaaacctccaccttgaatcactcttaaaaggtaagaatttatattatacatactttaacattcgcatataggcagaacagtcaggtattttccccaaatataaactctccgtacatctctgtaaagaaaaatacagacattacacattcatttcagttttcggtataatagcctcatttaaagagtctaaagtctctactgaagaagcataagattgcacttcactcttctctgtatctttttctgtggtccaggaacatgtaatgaatatcatcattatacaaaacagtaggataattccagatgctgtagttaaagcctgaacccaacttggagatttcccttcaatttttttcctcgattctttgtttttcgtgggttggctcgtcacagaatctaaaaacaaaccatccgtgatttttccattcttaaggaatgtatgcaaatatataatcaatacattaacataaaaaagacatatctttcactaaccggtatgtacagaagtagtggattcagtgcagctggcaagagatgtgcttacatgcttcagcgccacagtcacagcttcgagatcagtagtggtacgtttttggttcgatataatttccagcgttaacatagttattgccgcagctagtattaaaacgatcagacatgccagtatctttaaacgagtctttccagtagctgacactttttcttcatatcccatcatgatcagtgttacagattttcaagcagagaataatctctgcaaagaaagaggtggtggtaatctccttatatagtattatatctgctgacagaagatattttttcattggctaacagaacagtaggcggtgtctgaatttgcatcttaatatacaatggagtcagcaaaagatacaacccctacttctatgttcattctcggaaaaccctctggaaacaacatggaatccaatgaggaacgtatgcaaaagtaagtatgattagtccttattagatctatcttatttaaaactatatgggagtttttctaagtactaagaaatatccatacttacagctaccatcccgatccagtggtggaagaatccatcaaagaaatattggaagagagtctcaagtgtgatgtgtcctttgaaagcctgctttttccagaactggaagcctttgatcttttcatcccagagtcttccaacgacatcgcttccaagaatgtgtcctattccagtaatgtggaagaaggagcatctgaagaattcaaaactttggttggtgagtacatgaattatatattatatgtcccaagatagaaaacaagaaaaaaacatagttttaagcatgtaacatatagcatacttagaatatcttcttttacatcctagctcagtccgttggcacttgcatccaaagtattggtgcatcagtgaaggctgccatgaaacaggaactgtctaacatggaagacgatttaattaactccgctggcttattaacgctgcacagatccatgttggaggggctggtattagaacaattaggacagttgataaatattaatttactaagtagtgtttcatctaaatttgtttcaagttatgcaaaaatgttatctggaaaaaacttggatttttttaattggtgcgaaccgcgattcattgtttttgcatgtgataaatttgatgggttagtgaaaaagatggcatcagaatccagagatttgctcatggatttgaaagctaatatgaacaatcaatttgttatagccatcaaaaacattttttccaaagcttatgtggcattagattgtgaaaaattgaacatggtttccacctcattgttgttgatggcacacaacaaagagatgtccaatcctgacatctccaataaggatttttgtgggcgagtaaatttacttaaacaggaactactggaaagtagaaatgagataatagaaaaccatgttaaaaatatgaaaatgtttcaggaatttgctaataagcagatgaatcaaatctttatggataactgtgatagaacattccttaaaattcatgtgaattgtaaaaatttaattactgccgccaaaaatattagcactgctgttctccaaagtattgttctatgcagcagtgaattttcatggcaatacctcaaacctcacagacaccagtttaaaattaccataatgaatatgatcacccacgcatgtgaatacttagaaacagtttatgatgatactggtttgattaaacctttaacttcctctgatataatggaaggctacattgctataaataaagatagagagtcttccatctgtgatttaaacatagacccttcagaatcaatactattagagttagctgaatttgatgaacatggaaaatattcagaggaatcttctatcgaatctatccatgaagatgatgacaatgtagaatatttaaaatacatggaagtacaatctcctactgataataatactcccaccccatcaaagaacaatgaatccccaactagacaaaaacttacaaacatacatgaaaaagatgtagaaaaaatgtatccagatactccttctccagatgtgccagggaaatccaaagaggcaaaaacattcattgaaaatagcagacagatagggaaaaaacaaacaagccctaactgtgtatgtacagcctcagtgacagatctgggcggccctaataactttaaatccattactggccttgaaagttgtaaacacgtcttgatagaaaaactacttgaaactcaacccgactcagtagttgtagagaccgggtctgaacaacaagacattttggcttacagccccgatcaaaggtcacagacaaaagaaaggattcaggaaaaaggttctaactccaagtgtaccgaaacgcttccttgtatgacctttaccgactcagcaactcctgtcaaaagtcatgatgcaattcaggatactttaaatccagaaagtaaaatagacaaagaattgggagctgtagaaagtctagtgaatctatgtgatggtttccatgacaaccctttaatatcagaaatgataacatttggttatgaaactgatcactcagcaccttatgagagtgaaagcgataacaatgatgaaactgattacattgcagactgtgattcaactgtcagaactaataacattcatatgaataacactaatgagaatacaccatttagcaagtctctatattcaccaccagaggtcactccttctaaggaaaatgacaaaactgagaaaattgtgcctgtgactcagaaatgcaaatctaaaaagaggacagctaaaaggaaaaatgttccaattaaaccatccaaatctaaaaagattaagatagataagttacctgaaaccacaaacgtaattgttataagttcagagagtgaagatgaagaggatggtaacaataatattgatagctcaatcttaaaaaaaactattaaatcagaacctaattctgaatcgagcagcgagtcagatgactgtacatctgaagataattacttacatttgagtgattatgataaagtgatcaataatggtcattgtaaaagtaaaggttttgtatccccagtgtttaccatcccaataaggtcaatgccgggtacccatgatatcagaaacaaatttgttcccaaaaaaaattggttgtggtttctgaggaaaactcacaaagtagacaattgtgttatacacagttctgcaaaaatgaatgtaaaaaatgacagtgatgggacagaagccaatcactgcttcatcaatcactttgtccccattaaaatggatgatgaagaatataataaggataatgtctcatatacttatagtaaaatacaggatagcaaaacagacttgggagtcataacaccaaccaagaaacttatcacagaaatggtcatggaaaattttatggatctaactgatatcattaaacacggcatagacaaacattgccaagatctttccagtaaatatactgttatcacctctactgcatgtgagaaaaatttaaatgtgacaaattcccaaagtcttgtaacagccgaaactcaaatatttgacccgcagggaacaggaaataactcccccatactaaatattatcaatgacacaacatgtcacaatgatgagaacagatgtatggaaggtacaagtaatgataatgaaaaatgtaccattagaagtgattgcaacagtgataaaatggaagtctttaaattagatggctatccctctgattatgatccattcgaagaaaatgctcaaatttattagctagatgaaaccaagatgtaaattgattagcaatcattagcatacagatgtgtattatgtaaatatgcttatattgttgtaaaatacatacttttcccatactgtgtaactctttatgttgctatagattagaaattacataagcaaatgtaactttttctattatgtaaaacctcagcaaacatgtgatttctcaaaggaatttattttcaatatcaccttacaaataataaaaagtcatacagacattgctttctctttttaattccaagtcatgtacataaactgacttataagtcatcatacaatatttccataagttaattccagctttcttgaagatgtgatactataaacaattgtattcttggaaaaccttatacagatgccaagtattcagattttcactttctcttttccaaactaaaccagtttattaagactaatgccccggggacatcttaattttataaatcatagtactgctaaaaaatgtattacattagttgtagctagaccgtagcactctacacaatattatcctttcaggtctatttaatctgtttttgttcaacattcacataatagctcctattcatgaaaaaaaaaaaaaacattttcaaccttttgactttttacacgatgaaagtatccaaaccacatttcctaaatgtcacactactagttttttttttcagagacaacgttccattgttctatctgttttccaccaaacacttgaaagtataaatctaaaataccaaatccatctttaatccaacatcttattaactgaaatcactttgaaagtgggatgctacgcataattcccaattttggaaacacagattcaaaattactatatttatatattccccccccccccccatatatctatctctctctatctctttctctctcacacacacaaacacaacacacaaacacaacacacaaacacaacacacaaacacaacacacacaaacacaacacacacaaacacacaaactcagcatcttaacaaaaagcacaatagatgaaattatttaggtttaaaatattttaaaaatgtctatttaccacccttaaattttgacctgaacagcggagggcgctatcacatcagaaacataatcaaactagtctattcaaaactttcaatatcatataatttacctcaacagcggagggcgctatcacatcagaaacataatcaaactagtcaactcaaaactttcaatatcatataatttacttgaacagcgaagggcgctatcacaacagaaacataatcgaactagtctactcaaaactttcaatatcatataatttacctgaacagcggagggcgctatcacatcataaacataatcaaactattctactcaaaacattcaatatcatataatttacctgaacagcggagggcgctatcacattagaaacataataaaactagtctactataaactttaaattatcatatattgtattatattaaattatgtcatctccataatacataataaataatatataattgtattctaattatcaaatcatatccatccccacggtagcatcagtatctatttgattatgcatattaaccctttggtagtcacaaacttcagcaatttcaactccaattattcctgaatatatctataggttccctgtagacaaccaacagaattagacaattagataattgataaatattaccatatcttaaaaacatggatattatacatttcccccccccccttcaataaatctcacttttacccattatactggatttactgcacgtcaataatgaatgcatcaataatttaaatttttaacattaaaacaattttattataatataatctaatgcaaataagtaaatataaattaatataccatccaattcaattgccattaacttcatcaggtattatatataatttatgttaatgatcatcctagttttaaatgaaattaatatatgacacctaatatactattacacgcgatttccaaatatatggcatatcacgtgattgataaatcataaattctattattgaactactaattaacataaattctctaataacataagttctctaaaaaaagtgttcattacacgtaatttttcagcgcccgaacttgaactcatcgcataagaatagtgataataaattgtactattagccctacttattattaattatataccattaattattcaaaaatgtaatcaaccacgaaaataacttcaactactgaatgaaaagatttaatatcatgctcactaaatcccgtcgcttggcctgttaatagatcaattatataaatcatgcgtcccataaaatttctccaaataatgtcaatttcataaattttgaattgaattttaattgcatgttatgcgaataattccccccccccattattagtaatccacatctaactagttaataacacatcgcacgatatacatccttaagaaaccaataggcttttaccactctcctacatcttttccaattagtaaatgcattattccgcttctgcgacatttccacggaaagttactacttaattgataaatataaaagcttaaaacgatttagtgaatttcactacaaactataacgtctttatcatccaaatttatctatatagctcaacaatctaaaaaacaaaatacaaatttaatgtctccacgtatttactcaatgattattatgcaataaaagtctataatacgttctatagaaaactactattttattcatcattttattagaacacaccttgaaaacgtatatgtacttttctttactatatttgaaacttttcatattacaaaacgatggaataactttcatttgcatactacgcacaatctgtataaacatcattctctgcacgggatgtatcataatcaaaatgattatccataatttattaaatacattaagcgtatcactaatcgacggaaaaatactatctattaagcttgaattttataaacatgttttccagaacaaaaatccaaacaagcaaatgctcataacgacgttgtccaccaagccatgaaattatccggactataccatgatgcggacgtcacacatagacaaccattgagtgagaatacgcatcaagatcccatatcttctcaagattccagaaaaaattcaagaactccccaggatccacggagagcagctcagatccacagacaatgcacatcctctgcttccaatctaccatcaaacggaaacaattcgatccatatgcgttttgcttccgaactgccagatcaagtcctacagcccatgtacgcatcacagaaccaaactacaaattcacagtgcaatttcacctcgttgccgtatcaacctaattatgatgcatacaggagtatagagagttcctacagagaatctagaaataccgatagaggatatgactctaactttagacatcattcccatagacccagaggaggaaagggaaaatacgatagtcgtaattacttcaatccaaactcaaagtatcaacagccatatggaagattttttcccagaagttataacagacgcggaagaggccacagactacacgatttctcaaacagatccgcagatttatcatatcaacaatacatgcatccaaactatgaacaatataatccagatctccgtatgaataactataaagatgttacacaactaacaaccaacttcaattttcaagcccaagactatagcatggcattttcacaaacttcaataacaacagaccccacatacgtacaatctgacaatcacaattatccaacaaaatcacagacaacaccagaaactacgaaaactaaagaacatgagaatgctaaggataacaaagaacacaaaaaacagcaagtttcaacgtctcctgacgcaatcagtttatcatacagacctagttcccaaaaaatggatctcattaaaaaaatatatgacactgaagttatcccgttaccgaaggaagcactaatagacaatggctcaaattgtggcgtggatactcagaagtacaaaaaaacacatatccgttgtagatcaatccaaaagacaaaaggacacagttctcaaacaataaacaaacataaagtacaaaaacataatgaaaaccatgttccatcgcgttctgatcttaaacagagaaaatctaatcagcatgaagatgaagccgttactgaagctagggatttttcaaaattagatcccctgctatctcctcttccgatgacacctgagcccaccttaaactttgcggttcataaaactaaaattcattctaactcggaactccaccacacaaaaaaaaatatacaccgatcaaaaacttctctacaagacagagttctcatatcaaaacatgctccaagagccccgaccaaagataactcttacaaaaaacatcatgacccaaaagacactaatgatcctaaaatgaaacattctcggggacgtacgacatctaaaaaaaatactgcaaactccaacggacaccaagacgttagggaagtagtcgttaaaaatgtttcagggaaagccgccaaaaatacatcaaaaaagtctgatccctcacataacctacacggcaaaacatctgatgaacaatataaaacctcacccgacaatgaaaagatatctacaccaccaaaatcaaaaacgcaccattgtatacatgattccagtagctctgaagaaggccaatacaaatcccccaacaacagtgaaagcaattatggaaattgtttatcagataaattctatgataatttcactaaaacaacccccaacagcaaaacaaaccataaaacagaagaaagtaccgaaaatacggacttaaacagtttttccaatgaaaatacaaataaaacagaaatagaggactctaatattattcagccattttcacaactattttgtaatgaaactattattccatcaacttctgcatgccccacgcaagaaactccttcaactatgaacagaaactgtgcgtctaaaaaacactctgcaggcgccaacaaaaatttaacagacaattcacctattcggagtcattccaatcctagctcatttactgcttttaacaaatccaacagtggcaacagcaccatgaatagcacttctaacggtgatgaatgtactgacatgaaacctaactgcagttccaccgaaaataaatctgaaacttctaaccaaactaatggcgaaaactctgataaacctctgagtaaaactttcaccgaggtctctgacagagcctccagcagagcctccagcagagcctccagcagagcctccagcagagcctccagcagagcctccagcagagcctccagcaagacctccagcagggcctccagcagagccttcagcaaggcctccagcagagcctccagcagagcctccagcagagcctccagcagggcctccagcagggcctccagcagggcctccagcagggcctccagcagagcctccagcagggcgtccggtagggcttccagcaaagcttccagcggagtctctagcaaagcttccagcagggcctccagaagagcctccagcagggcctccagcagagcctccagcagagcttccagcagagcctccagcagggcctccagcagagcttccagcagagcctccagcagggcctccagcagagcctccagcagagcctccagcagagcctccagcagggcctccagcagggcctccagcagagcctccagcagagcctccagcagagcctccagcaggctccggcagggcttccagcagagcctccagcagggcttccagcagggcttccagcagggcctccagcagggcctccagcagggcctccagcagagctccggtaaaacccctaacaataaattaatgtccaacataccttcccctcaaacttgtgaaaaaacttcaaacaaacgtaaaccgaggcaaatttgttgcgattctaataaaagacaaatatatccacatgacacctcaattagtacagaagctgaagtatcagaaatcaaatttcggttcgggcctgaactcaatttctacaaaaatactgcagctcgactccagtcctttaaccacaatgatcaattttacaacccccgattcagacctcatataagaaccaacagaaaaaaatcagaatccaccaattacaccgattcagaaagttctacatctagatccagatcttactctcgttattcaccagattcactcaatactccaaaaagaaaaaaacacaaatctggatcatcaagcatctcttccagtattgaagaaaattccagatctaattcacgtacagaaaccggaacagacaagcttataacatttaactatcagcactccagaactagatcatcatcggcatcatcatcatcagtctcttcatcatgttccagttccagatcaaaatcctggcgcaaaagtcgatataaaaacagtgaagatcctgccacatattcacctagatctagactacaacaactagaaaaacaaacaagacctaaatcagcttcaagagacaaaaccaaaatcaaatctccaaatcacgaatcaaaacatagacatgcagatatgtttagaaactcccagaaaacaggtgaaaaatttcccctagacaattctagtccatctaacacacatgaacaatccaatcatttagaaaacgccattgatcaagaacaaaaaaagacacctaagaccacgaacaccaccactaacacaatttatcgcccacgggataaccaaagtaacatatcacgcaacacaacaaaatgcaaaaaaaagcgcacccgggatgatgattcagattccagtatgcaaaatttcttcaagaaaagaatatctggaacgaagaaaacagattctgaaataagtgaaattgaagaagagttgtcttatagagaatatgttagacgaaaagaaaaaaaagaatcggcaaaatttaaaattcatcgcggcagggtgtctacaaaagattttagaaaactctttagaaataccatacgagcatttgaatacaaacagatccccaaaaaacctttccctgaaaacaagctaaaagaagctgtatacaacatctgttctaatggatgctctaacaccggagccatcattatgtactttacaagatcaaaacaagtagcagaaatcattaagacgatgcaaagagaattaatgattcgacccaacatcactgtttcagagccatttaagatgaatcatgcaccgcctaactattatgacaaagatgcaattaatcaatttatagaactacaaaaacaaggacctcaagaattgtgggataaacttgaaaacaacacacatgatctatttacgagacattcggacgtaaaaactcttatggtttacgccgctacgcccatcgactttgtaatggcttctaaaatatgcaataagtatgccaaagataaacctaaagaaattgtccttcgggtctgctcaatcattgatggtgacaattctatctctatctataattctgtcagcagagattttaaatcgaaatatcttacactttcaaaatgttaactcccaactttttttttaaataaaaaaataaaacagtataacggaaatccttgacttttttttattttgggtgtgacttatatatatccgaaaccgctatttggcgcagaaactgctatttggcacaggtgtacactatgagtcccttgatgcttcgattattgccgcttctatgtattatcataagcgcacattttgtaccccgcccggagacgagtccttctttagtatacgaaatagggtcaactgttactttccattgtcgcctcaacacaacgacaaacatccaaagcgtctcgtggtacaataaaagccgacttatatcgaatcatgaggtacaaaacatggacaacttatcgggcactgacgatggctacgtctttatacacgaactaaataagatcaacaatcttgacgtggacagtaaattgtatttccacataaaacacgatagaactacatctctgttgaaaattaaagccagatcagcatatgacgcgacatgtttaacctgtacattcacagtggataacgagaaaacatctgcgactagttgcttaaaactcattatgaaacccatcgtcgttttgtattttcgttacctaaacaattttttagacgttacgtgtaccgtgacgtcttatccaaaaccaaatgtggttattaaatttcttggagaagtatataagagagacataccaatggttagacagaatgaaaacggatcgtcaaccgttagtgtgagctttactttcaaaagacgaaccaagctggaatttgtcggaaaaaccatctcatgtctagcgtcgagctggtttaccaaccaaaagcgtagcgctctcgtaacttccggcgaacacactgtgcaaaatcacgacgaatacagtaaagaagcggtaaaaggctcaaattctgacgaaaccgtatttacctggatcgtaccattaattctgatattgataatatcagttatggtgctactgatttcgatgtgtatcgttgcatttaaaagttaaaatttatatggcttaagttcagaagagatgaaagacagaggtaataaaaacacctctaaaacaagacagaccgtcaaatctcgccgaactagaaaaacaacgaaaccgtctacagaacggaaaaaaaatctaaccactaaaacgactatacgaaataatcgattacaaaacaatctatcttcgcaaaccgtccaaaccgataaacccgtcgattctgccactgcaagagcctttccccagcacacctcgcccgacataaaatttaataaggaaaaatatcgaaataacgcaatctacgcccattccaaactacggaaaatctcaaacgccgtgtttcaccaaaataaagaaattaatcgtttttctgcatttacggacaaacctctcgccgacctatcattcaacatgcctgtaaagacatcaacgacggagaaaaaggaaattgtcaagtctacggaatgccaaaggcaagatccgaatgcagtcaacgctttcaaaatttttcaatcttacgaaacatctccaccttactccccgtgctcacctaaaaattttatgtcagaaatttacagattattccgctgttacaacgcttcaattgtgcaaatacaggtttattcccgaaataaaatcttaataaacgccatgcaagaaaaattgatgtccattggcaacatggttattaacgtgggcgagcaaataatttctgaatcggttcaccatgaaccggtagtcgctattgcaatcaatcagttttttagagggaccgtcccacatacggacgcacttcgaaaaaacgctgtagctcctataccggtaaacgcctcaaaaaaaaagcttgtcggcatttgctctctcatgataaacgcgccgacggaaaaagatttattatgcgccgctcacgtttgtatcaattttgcaatctgccatcccaacgagattactctgaatatcgcgaacgtaacacaaccgatgctccttcgagaacacatcaccatatacaactctttcaacaaatatatttattgggatgattatggcaaactattaaactgacaaaataaacttttttggctcgaatctaaattggtctctctttgcgtcctctatattgatcgtcataacgagaaagaaaaccagtattaatgtcttcgaatagtttcatgattctttgtctaatttcgacaatcctaattcaagacttgtcggcgatgcgtttgccatatcacacatcgagccctgctctaaatcagacaggtaagcagcaaaacaactttttagctttttaatcatgattgcaacaaaaggttttctgaaagtctctgtcttcccaggtacgacagcggaccaatctgtgcaacacaacaaacatcctaataagacagaagacgaaatacgtgaattttctgaagacagctccgcatcgggggaactaccgataaatccgatagccataccaatatatgccgcataaaaaaaaacaataaaaagccaaatgaacatttcgacaagtctttttccctactgtatataagatgttgttcccgtcgtgttaacttctccaaataaaaaataaccatggaacttttactatttgtaatgtcactcatattactaaccttctcgaaagcgatgcctcttttcgaccacaattctttctattttgaaaaacttgacgactgtatcgcagctgtaataaattgcacgagatccgaagtacctctattactagaaccaatctaccaagctccggtatataatgaagacgttatgtcaatactgctaaaacccccaacaaaaaaaaagccttttagccgtataatggtaaccaatgaattcctcagcgacttcttacttctgcaggataacccagagcaactacgcacattgtttgcgctgataggggacccagaatctcgggacaattggctaaactttttcaatggcttccagacatgttcgccttccgtcggaataacaacctgcatcagcgataactgtagaaaatatttgcctgaaagaattacgtacgtcaataacttttttgttgataacattgcaggtctcgagtttaacatttcagaaaacacagacagtttttacagcaacattggttttttattatacttggagaatcctgctacaggcatcacaaaaattatcaggttcccttttaactctttgactctctttgatacgattttgaattgtttaaagtatttccacttgaaaaccggagtagaattcgacctgctaaaacagatggaagcctacaattctaaactacctttccgaagttcccgccctacgattctgattagaaacacataattggctatgacatcacgtcccattcacataaaatgctcctagggaatttaatccactgcatttcatttcccaaccatggccctactacagtggatgttagatcacgttcaggatgaagaaaaaaactatgaaaacctttcaatagatgatcagcattcactcttcggcataaacagagactggttgagtttcctgcaactctccaagttagaaattacacatcttaagcatgtttataaattggtggacaacgatagagctcatctaaccgtccacccctcttcggataacgtccacgcctggagttttttgtgcaaacccaccgatgttaaagttgtgattctgggacacgatccgtatcccgacggcagaggttgcggtttggccttcggtacagtgaaagagtgctcgattccagaatctctaaagaatatatttaaagaactggaaagaagcatcccgaatttttccccccctgacaacggctgtttaaactcctggtgtagagaaggagtcctactgctaaactcgatattcactgtagttcatggattaccaatgtcccacgaggcatttggttggcaaacactgagctacaagattatcagcagactatcggaacaaatgaactctctcgttttcttgttgtggggaaaacatgcccggaaactctcttatctaatagacgcacagaaacatctcgtcttagaaagtgcacatccatcacccaaagtgaaagctgcaagaatgccatttattggttgcaatcattttgtgcgaacaaatttatttcttactgagcacgggaaagacccaatcaattggaacattctgaacgaatagaacctatttagtttacataagaattacaatacagcaataaaattcacagtgtttccaatattgtggttgccagtaagtcttcattaaaactcccagcattttcaaagttttcggtttcgctgctatcgtctatgacaattgcagaattttgtgtccttaaattatttagattggaattccgtctcctgggaactctccctcggccacgtcctcgtgctctgccccggttttgtcctgaaataacacgctgctgcccgattgcaccatctgttgatccgacggttgttctggtccgttgtcgaactcttcttgcgttctgcgttgtttcagtttcaaatactcgcatgtcgataaacggtttaatctcacacacaggtaccgacctgacacaatcagaaaacactatctgtttcttttgctcgatatgttttgttttacttaaacatttacttggaacagtaacatcagcacattcaagtacattttttattaaattatcctttacataatccaaacgctctttcaatttcgaaagcgatctttctacaacctcgccgctgcttgcaacaagtctggccctaagctgttctaaagacttattaagctgaaaatttccataattatcttcattggatagaccttctcggttcgtcccctaaaagaaaaagatcagctttagatacgcacaacaaagactccaaagacctaggttttggtgaacccaaaactccacccacctgcgcataaacgcgcttgtctaattcatcatgttgttgatcttcgtgattatcaatagaaacacagggcgataacgcaccctcaaccgctccattcacgaatgtcgtagaagtcggtgctatgccatcttcgtgactttgttcttccaaattacgtttcgtttcgtggtgagatttctgtctcttctccttagggggttctgaaatcacaacaaaacagatactatttaaaaaagtccacgaccgtgacacaccaataataaaaaaatttacaacagctacacattcatatttaccatcaaattcatcctttttgtccggccgcttgtcttcgtcgtttcgttttttttcttcttgttttagtttctcatcttctttttttttgtcaatgtcctccacttttcttttttctttctgcttccccgagcgttttctgtgttcatcgtcgtgttttttcctgtctagagctcgacattctttttcaaacttttccataaatttcaaatcgcccagatttcgtagctcgggctccgaggaaactttagcaatagtaacaaacgttatttgaagttttccgttttcatgggaaacagtcaaaatcctctctctgccctcagtattctgagaaatcgacgtgattgattttgaacacagtaaaaggccccgagctctgtacgttctgcattttccttcatccatcccaatatccaccgttagagaacccattgaatctgtctccgatgtccaataaatcattgatatccatcctttagaaaacgtttcacacgttccagagtcagctaagaactcaatgaaacagccattgtcgaattcaaaccttttcaaatgaagagactgactaataatttgttcataagcctgtataacattgtcaaatgacccatatccacgttcttcagcatacatcttatctgtgtgaaaataagaacaaaataaacatgctcgacaccatcaaaatacacatagcaaatcgtaacattacagaaatccagaaacgactacaaacgagacatacatttttaccaaaagaatcccagaaaaatctcagaaagatgagttctttgccgctcatccagcacaaatgagctagcgagcacagacaccagcgcccttttatgcgcacgaatcacacttccgggctcgagcgtttgcgatccaaaaactacagcacacaactaaaacgatttatttctcccatgaaacgacatatctaagtcagacaacgaacacgatataaaaatctattaaaccgatatgtggtccgacatctaaaaataccgttcggcttttttactgtaacgactttttactaacggttaaccacatcctcatccaaaccgaaaacctttacgtattgcgtcagcgacaagggcgtggactttaccgtaaaatgcatataaaaaggcttgtcgcccgtcagaagtattagggatcaaactgtaagtctcatacacggcaaaacagcgaatgctaaaccgcgaactacaaatcacgtgaagcttgatgcagactcttatacagattgaatgtatacactttgatacattatggagcataaatactaaaatgtagttagatcgaaatgaaagctttatgggactattaaaattgcagattcatgcttatgtaaacgtgaataaattcggtgtttttgatgttccgtgaaaaagtttacagcgcattcgacatatggaacttacgtctactcgaacgttgacctgttgtagcttcaaggtaagatttaacctattttgcatctacgcacttccaagagctcaatacaattttgtatatgccaaaaaaacccctttagtctttttaatagaaaatcgtttatcaaccaagatgtaagttagtttagtttccagcgtatagttatcgagggacacatcattaaaatctgcgttgcataaaaacttggactgctaaaaattacacttgcttaaagaaatagtcatctagttttcggaaaaaaccctcgttcacaccatgctagcctgaatggaaaatcgtaggtcactggttctttctatacgagatgagtatgcttgcttattttctctattgtcgtcaattgcttctggctgtggttctcatagaatttcccccgtctgtgtggaaacacccttcaattttactcgtatcacctacctctctctacttgtcatatctccgattcattttatctaacatcaagaactaccagtaacttgttgttttgccatcttctatattgtcatcagaaaagtcatcagaaaagtcatcagaaaaaaactacaggatatctaaaatatttttcgaataccattgaaaacatcaaaaacatgttcaattcatcaccatatactttgagtacaactgcataacattgttacaaatttcaatatatgattttcggattgcgactcggacaccggtaacctcgctcacagtatttcatatattgtgttgtaagatacggacctcatgagtgtttgacgctcatgaagacggcaaaggcggctgcttttgtcctttttactagttttcacacgttgtatcgaaatgaagccagagattattcacggctaatgatatgacccgatcaatacccggcgaatggataaacgtgtctgaaacctagaaaccgctacgctctcggaagaattcaaaaaccgccaagagatagaccttgatctatgtaataacgtgaagtgggcctcgttgtttcataaatcaaagacgattgctttagtagtgggggattgggcacaaaacagttgattatttagttcacattataaggacctaaaagttaagtatagttgataagttaagtttagtctataagtgtagttattaagtaagttaagcatctaactaatcattttgtgattccaatcattactcctggatttttgtttatctggattcatacagaaacattggatcatatgcaggcttttgtaaataacctattattactaaaaacaactctaggatttaatggacggatctagcatatttttttcgtcatcttattcttaccccgatacctagaataacttcagtagtgcaaaaaataaaggagcttcgattgatacttaggacaccatccaagccaccacctgagttaacatcaaagtaactattaacgagttcgcggctgcttaataggctaaattgtgcatttttgaggtttcccccggagtacatacgtgtactccgggggagactttcatttgtttttgcagatgtcatctcataccacatccctgcagctgtattcaatttagcgacgaaacaaaatcatggccgtaagtcatttctcatcagttcctcataaagtttcacacccttgtctttttcgagacatactgtactaaatccctgtactacttttgttttgcagaaaaaacggaccgacggaaataagctcattcgaccgtatggaatttcaacaattacacgcacaattcatctgatgttttagttttttttatatattctcataaaaaacctccctaaaatattaacatggtattttcgttctttaacgcttttacaatatgcggagcaataaaattatcattctcataattcagtctcaaaggattaacattcattattaaattattcgggtcggttactcgtgacatcccaacataaatagaactcaattttaaattttttggatcactcccgaaatctattgcgaccttttgtatggaaagcccttgacttttcgtgatggtcatagaaactttagaaacagtggcgtaatcgaccgttgtacatagatgaaaactctgaccatttacgacatcgacaaatttcgacacgttattatctaaaacagaaatgaaccccatttcatcttttataactaatctaggtaatccttttttatataagatctgcggtaattgtttatccgttcctaaatgaactacattatcatttgtataaccctccagagtataattattggcagggatagcgtaggtgagcataccataaaaactctttaaatgggaatatatctcaccgcactgttttctagaaacgttgtttctgttataagtcactaggagagtctttccgaacttcccttttgtatgcatctgcagaatggcaaacctagatataaagatatccttaaacgtcgtataaagcaaactaatttcctcgaacgacagagaattagttaaaggcaacttactatacctagtaaaaaatggatctccgcaaggatcaatttctaataggtccatatctgataacccatcatcgactaatccgaaatcatacctttcatctgtctctacggtttgcacgtctcgagacatcctcgacatttcactttctaagaattcaatactgggcatctttatgtttttgatttccattaacacttcaggggtggtgaattccgaacagcagaaagaatacatccctccgaacataagaccggataaaaaagaatatgcgtgaatagtctgctcacatgacgttttttcgataaacaaatcgctctgtaacagttctacaaatttttcataagttccggaaaaccccacggtcgaagccttgatcttggacgtcacacctattgaactgtttctgatatgtttcagatgacaggttatcaaagtctcttccaccgacccatcttccaaaacaatctcctccaattgaacagttttcgataaatcctgatccgcgaactgagaataagtattcagccgatgaatattagatttaaaccacggttcaatttctaaggagaaattaccaatttcacttttgtagtcttcgaaagtcttgttttttatgagaaaataaaccggaaacacaaacaagttatttctgttggtaacttcaacctgctcatgcaatgaacggaaatagttctttacctcgttatgcgataaaaacaagcgggtcgtttctatttcgttcatgggatttcttatgtacgaagcgggcttcacaaactgatcgacatactctataagctccggctttaacggcaagccaaattctatgtgctttaaaaaatctccgaacgcatgatccgcacatcttttgttgtttacaaagattatccagttattatcgacttcgcaatatttagagagcacgtcgtcgcagatcaaggctgaaagtacatctattcctctcttcacgtccttgttttgagtcagcggattaaatgaagtcaccaaagcgttactctgcgtgggcgaccccacacacacgatgcacggaacaattccgttctcatacaaaggggttttatacaacgcgttataaaaccaatagaaaaaaacaacagtgtgcagaatatgtcgtaatattacgcctgcctcgtcgataactataacactactctcacacaaatcaggtaactctttagttttgcacgcgacagcacccaacgccctctccgctatgtcggagataacattccaatagatagacaggtcttgcttttgttgaatttgaatcgacctctcgtcatttgcaatataactttgacgttcgctcatagatacatgtgaactattaaacccaaaagtcttaaaaattgttttaacttgcgcggatttacttctgtttaaaacaacgctcaaattctgagcggcgatagatgtcgttgcagtaacgatacaatctaagttggccgctaaggtctgaatgctgttcgttttccctgccccggccgtaccggttactaacaaggccttaaacggcaaaaaaggcagaggttgagcgaattcatcaataccgatgcacagagcatcagcaaattcgctgttgaactcggtttcaggatccatgatgtggcgaaaccaatcttctggcagacgcccctccaagcgtctttctgataacgaagccaccttatctacaatcaactctattttgggagccgaagacatgttaagcaaaaacttattatcgtatctacctccgaacaacgaagagatagacatgatttatccctctgagcagataatgacttttattgaaatgctacacggacacaaaaattttttcaaaggtcaaacaatccacaacgctctccgagattctgccgtactgaaaaaacaaatagcctatggagtagctcaagcccttttaaacagcgtttctattcaacaaatccacgatgaatggaaacgtcatgtgaggtcatttccgttccacaacaaaaaattgtcatttcaagattattttagtgtctgggctcacgcgattaaacaggtgatcttgggagatatatctaatataattaattttatccttcagagcatagacaacagtcactataacagatatgtagactggatctgtaccgtaggaatcgttccgttcatgagaaccacccctacggccccgaacttatacaatcttctacaacaagtgtcatctaaactaatccacgacatagtgcggcataaacaaaacattgtcactcccattttattgggtctatcttccgtgatcattccggattttcataatattaagattttccgagatcggaattcggagcaaatttcttgctttaaaaacaagaaggctatagcgtttttcacgtacagcaccccatatgttattagaaatcgcctaatgctgactacacccctcgcccacctttctccagaactaaaaaaacacaatagtctgcggcgtcatcaaaaaatgtgccaattattgaatacatttcccataaaggtgctaaccacagcaaagacagatgtaaccaacaaaaagataatggacatgatagaaaaagaagaaaaaaacagcgacgcgaaaaaaagtttaatcaaatttttactcaacttgtcggacagcaaatctaaaataggcattagggacagcgttgaaggatttattcaagaaatcaccccctctataatagaccaaaataaactcatgctgaaccgaggacagttccgaaaacgctctgcgatcgacacaggagagagagacgttcgagatctgttcaaaaaacaaatcatcaagtgcatggaggagcagatacaaacacagatggatgaaatcgaaacactcaaaacaacaaaccaaatgttcgaaaggaaaatcaaagatctacactctttgctcgagacgaataacgattgtgatcgctataacccggatctggaccatgacctcgagaatctctctttatcgcgagcgctaaacatagttcaaaggctcccattcactagcgtttccatagatgacaccagatcagtcgcaaacagttttttttcacagtatatcccagacacacaatatgccgacaaacgaatagaccaactatgggaaatggaatacatgcgaacctttcggttaagaaaaaacgttaataatcaaggacaggaagaaagtatcacatactctaactatagcatcgagctgctcatcgtgcctttcctaaggcgactcttaaatatttacaacctcgaatcaattcccgaggaatttctctttctatccctcggtgaaatcttattagccatctacgaaagcagcaaaatcaagcattatttaagactcgtatacgtccgagagctaaatcagatctcagaagtgtataatttaacccaaacgcaccccgaaaacaacgagccgattttcgattcgaacattttctccccaaacccggagaatgaaatccttgaaaaaattaaaagaattagaaacctcagacgtattcaacaccttacacgtccgaactatcctaaaggtgatcaagattgataagtgcgtatccctcgcacgacattcgttagtaaatataacagtaggagacgacggaatatggttccacttggaagacggaaccatgatcaacggcctggaatacaagaccatctgcgaaaaagagttgggattccaaggcttcattggcatcataatactagactcggaagatacactgcaagaactgcgactcaatccttttcagttcaaacgcagactaatccatatgaaagtggatacgccagaagaatttatgctttgcggactagtgttcgcattagagaatcttccactgaagcaaagcaccctgcacaaactaatcgctaggctcgttcttttccccgtcctatctccggtaacgaaaatattattcaacacgtgcgacaaattggtttgtacactaagacacattttttttaacgaacacgcctcagaaatcctccacaaggtgcctccgatgattagactatacaatgaaatgaaaaacacgcatatagaagttttggaactttattttaacacaaaacgtagtcacaatttcatcaatttatccttagaatctagacagctgcaagacagttctctccaagtcatacaactagcaacacaattcgcacaaattttttattcgaagaatgaagacacgtctagctaagtcttatttttctatgttatgtaaagaaacaaaattaattcaaatgtagcaaatgaatgtgttcatagagcatcctgttttcccacctaataaactctgtctgttcaacgtcttcaaatttactctccacccatctcctcaacactctcaatgtaacgagaatgtaataagaaaagtttattttgtcagtcaatgcaattccacgtgcttgtctgacaagctgtccatcttcagacatcacggccgtatatctactgcagtccagaagtccttcatgatattccaggcaataatcattaggatcgaactcttcgatccaataagaaacattatacctattagctataaaaacacacatcatatcctgaaaataaacagttatactggcaaagcaaagacctgtcttattggcccgaatacatgcagataaatatttacttgccgttactgtccagtgcgcttctttagattgtgacaacccactgcttaaaaaaaatctagcgtagaagacaaatccacagcgcgaaatttccatacactgaaatgcaggtctttgcttgatttccgtaattttttcccaacagttttcaacggccgtttgcagtaaaggcatgacaacatgtgaatctttaccgtcacaggttaaataaaacacgtgtaagtccctcactaacagccatcgcatttccattagagtacatgctcgctgaaaagcggaaacaaaagcatctaacataaagatcaccgcatcgaataaagcgtacgatctgtgttgcagcctcgacataaattttaaaagcagttcgatttccgtggcgttttcatcaaaacatggcagaaaggccctaggaaccgtggacttcaataatagcctcagacaatctggcaaagtcactacatacatatcactgtcactaaagaatagatgtgtgtcctcgggacctgtctgaaaacacagagactcacttgaaacatactgactattgaacctgaaacgttgcaaagaggtttcacttccaggcatttcaacacttagctccctaattacggggatcgcgtgtctaccacgaggtcccaggataggcgccaaaccgcaaaatgagagaatttcacggcagatataagttgtatccggaacccgcctttctaagtccgatacagacaaaagccacagattcggatatcctataaaagaaaccgatctttcattcccaaagggccataagtcgggaccgatgtattcgcaaagctgaactaacacctgtttataaactccgaatatcttctcgtgcaggaaagcaaacacgctctgcagtaaaagcaaacacaaatcatcgtcgaacaataaggcataagcattttttggcgtcactaagagaacttgctcaccaccaaaagcacacacagaaaaataaaaaatttgtttcattttttcacatacagcctcaccggtgtccgtgtgtgaaaagcaaatttttacatcagacacagttagcgaaaagtgaaagtccattacactgtatccaaagcgaagttttttagacgcctgtgtacattcgttactcaagagatgcttggtgtccaaggctgcgtagtctccgacacatcgtaatataacaggtaccgtgtccaaaggcagcatgggttcctcgccacagacgtatgcttccaaaatctctaacccgtcgtctccaagaacaacagttagaggcacgaaaaattttgaaagtttcctaagaagctctccgttattcataatgaggctgctgattgctgctatttttttgtccatcatattactttgttcctgaaggtcccaaagcattgtttcttttcttgtaacttctatctcatttaacgattcttggtctaggctctgtcccctaatcaaaaacgtttttaacgaacgagtctccgcttctaaaaacaaacactgaaaaatcggtactctgtagatcttattctcccagtcgttgtacacacaataaaggctaagatgacacgcacacccccggagatgcatgttgcccaaaaactccaacttcactaacggaaaggcttatatccgagccttgaagtttataaattgtttgtttccgccttgctctcgaggcctcggtgagggctttacgtagttctttacaagtcttaagattggtgcgcgaaatctcccaattgtctagcatgttctccagatcattttttgttagattgcgatacgccttccccgggatgtaccgaggtttgctggcggacaaagtcatattaaatgcacatttaaagaaaagcctgaggatggaaatgctgaatttttctatagaaaacacacccgtcacaatccgcatgcctctcaacttgttaaaaagctgcagagtctgcagactgtatctttgaaaaaattgcacatgcaccgtaaacaccaattgcattatttgtaagatgtcactcgacctcctggccgcacacaaaaggagatcatcttcagaaatgtcagtagtagtatctgtgcacgatttcagtttcaaatcttttcggatcatttccgccaggaaggccagatctattaacattccccactcgtaaaccccagagatgtcacctagaacaaagtactcatcgcacaaaaaactcttcggcagcacataagacttaattcgctcagtaaaaactctttcgattcgcgtgctttctacaccagcagacacacatttttgtaaccagacgttcacaaaaacatagcgtttgctttcatttttcagatcagatacaatgtccgatgcaatgaaaatgtcaacgcccggagataaaaaagtcgctctgaactttcccatgtcggtaatatagtccttatgtaatagctgattaccgttttcataaaaatctccgttcatgatagtttctctgctacttatgatctcttgaaacgtcatgttgtcacccggcaaagtaatcttcttttcgataaaatgacactcctcaactagaatttgcaagaaactcaaaaaaacctctttgcgcatcgggaatccatttccaacaatgtccaccttaatagaattctcacataacagactgcagagcagaaagagactatctgataaacttgtaatagtagtcttttcgatataatgcctgtatcgaaaaagacacttcagtacggaacagaaattatatttatgcgctccgctgcactttccgcggaagtcaatgcaactctctgagatgatagactgctcagcgacactccaatcactgcaaggaggcatggcaataggcgccaaaggatcatagcttttaattagtacgggattcatgtaaatgtatatatcttcatcgataactcgcctcacacgaccaatggattgaaatattgaaaccatgtccggccctcctttggccaactgaatgtaaacaaacaaagagctgaaataaaccggttcgaaactcagaccgacagtcacgacggacgtataaatcactacgtcataccgtatccaagattctatggaagagcatttcccttgtttagacgtcaacaaaagaacttttttgagtgaaaaccgagaacgtatcaaatcatgcatgtattccgctgccaacacggtgctgcaaaacaaacacaatttcttatcccatcgtagcttgtcttccaagcgcgcaaaaaaagaaaactctttaccaaaaaacgtgtcacaaaagtaagcgaccctattggaaaacatcgcggacacaaatgtatttctgatgagggcgatttgagtatctggcttgaacgcggcaaaaaactccaccacatgccgagtcagcgtcgcatccatagctattacatgactggaatttttgatcagcgataaaaacttgcaatcaacttctttggtttttgtcatcgttttggaataaaactgctttataatcgacataatttcatctaatattaaaacatcgtaattttctgtaagacgatgcaagctttctatctggacaatgacttttctgttgtttatctgccgctccgtaatatcgcaatataattcaaaatcctccaacccattgagagtaaaacggtgcaaaatttccgcagcgaacgttttacggcaagaaatcaaaaggacagatagttccttgggtacctgtttcaaaaaatgaatcaaagctgttgttttccctgaacccatcgctgcgcgaaccagttttatcggctgcctgacgttttcaaaactcaccgccgagtcggcttgagaataaacggtgacattgtccggaaatcttacatcggacaaactctggccgaaccactctgagaacagagtatcgttctgaaacctgttctccatcacagagctggtatggcctccagtcgtgtagacaccattaatttacggatctggctggtctctataatctgtgcagccttgtcatttataaacgtcacggtccatctgatagccataaactttccaaatttaggatttccgtgcgcctactttgaaatcaatgacctcaaagcggtcaatctctccgctaataatgaaatatatcagatgacgcatcaactttacataaaccctgtgcagattatatgctacgtactgataatggctatcttattcctcctgattattatttattacattgtctgctgtgcaaaagtgttctcctctaacaaaacatctaacgttaaccaaacaacgagggatattacctggatgggggacacctcatcctgctttcaattcatcttaatcatggatacatttcagttattcgtcaccgccctgtctttcagactggtcgccctaggtgcatttgcctattccatcttcttcgtgtgtttcaccacctttaacgttacgctgataacgcaatttcagtcagcggacaagtcgtttttcgcctttcagaaaattcatcctaacctaaaggggaccgtacaattcaagaccgttgtcatcaatctaagcgaactcatgctaggttactctacgatgtttctcggcattactacttgcctgggcgtcggaaatagtatctacatacgttccatcaccgttgctttctcttccatcaatacctttcttgtcatggcttgcatatatagtatagtaatagaagccgtcctggttcgctacgttaaacccttgttcggctattacgtcggtatgttttgtggcgccgtaggcctatctttccctattctccagtacgaaactttctttgaatccgagtggagcacaggacttattatcaatttatcggtcgtcgccataatttcgatcggtttcataatttgtcgactcgtacgctacctagttaaaaagaagcgtcggtacaagcaactacttaacgctgaaagctcgagcctaatggatgaaaacgaataacacttttttttattacaatcatgtttattgtcaaatagccacaaaataaaatacgagcgtgtcgtaaatctgcgtcgtctatcatttttttgatttaagcggcagttttttttcaacttccgtatcacatttagcagctaatgtggcctgtactctttcaagcaggggcttttcaagatctgccatcccttcctcttccgattcggtatcggtcaaaacagtaaattccgtcgtcagtaatataggatttcccttgtaatccatcagggtgttttcggttttcttacacatgccgcaagatactggtttacagcactttgtgcccatacttgtaaactggtctgcttgcaaatattattttcccacagattgcatatgtctgttataacacgacaagtaaattccggattcggtgccaccggagtcacaatcaaggccaaaggtatttcttcttctatatattccgtctcatcaattaccaaatgcaaactcctttcttcctctgttcttctcctgaagagagccgtcacaatgtgaacagaaggcacttccgtactctcgatatattctggattactatgatcattaatataaaactgagtcattacatattgttgtaacagactctgaaaaaaatacctgtgtttcggatttacgaatacgttcacggtaaacacagccttctgaaacacagacagcttctgctcactcaagtggctcttacaatcaaaaacgattaccgtagacgtctgtgtctcgttcaaacacagcagttgtttgatatgaggtgtcaaaatagctggagtggggcaagtgcgcaactttctctgaggacgatattgaaaatcatacgtcattaaatattctctagatgacggaatcttccctctttctcgaaactctatggcaggcaccggatgagataaaataaaatccgaaaaagatttctccgtggggttttttaatagttcagaaacaaagtgatcttctttatcccgtaaatatttatatctgaatttaatctcaaaaatcaaggctttttccttaaccatcaggaatccatcctcattgaatgaaattccaaaacacgcgtctagagacgcaccgaaaactccagatgaaggatcaagcagcaatcccaacgtttccttgacttcccttttaacgtaaaagatcgctactaggtgtctaataacacgctcatgtttcgcgccgtaaatcaccgcttccccaaaaaactgctgtcccttatgttctaaaaaatttcttgtcgtgtagatgtcatacagcttagttgctgtcacggtatatctccgtaacgcatgccagagcggattttccgactgcccccgagtttcacgctctacgattttaaataacttgttcacaaatacacaaggcgcacgacacagagcagaacacaataacggacagtaatcgtacagcttgcacaattcactcagatccatagaaacgtcttccgatccatccactctcgcgccgcacaaaaactgctgcatttcctcaataagtttacggcccaaaatgcaattattgttagaagcgttatattttattagcatgcagtaaacatgacacaagcgaacaatcgaaaatggaacttgcttgatcttttcccgtatggcgtacagtttatcaagtaaaaacatggttaaaggctcttcttctgccacggcacttagtgtttcagatatctgattaagatccattactatatcacatctgaaagagagatgatgtatctttatccagatctgcagaagaagtgatcaagaacaacgctctaaggtcatgtaaaagtttttctccatactcggacgactgtagagacgcaagacctcctctgattggctgacgtctggtaagtttactattatttaaaaaagttgcctcaaacaggtctcgtaacccaaattcccctctttcatctagaaaatcgtatattttttcatatatatcaaccacgtctcggtaaaacaataaccctagcaacactacatgctcagccaatactttacagcaagcatccctgtaagcaaatggatatctaagaggattcaatcgacaggcctcgttagccaacgcaaacaaccttttctcgtagtatagctgagcttcgcggcatccgcgtttatctgtcattctcaggacacacaataatacgacctgagcaaaggcgcacagatccaaattacagtgtctaagaggattattttcaccatcaaaagcctcgcatacattgaccaatatcattgcattggcgacaagtggtcgaaatccaggattaaacatgtcacagaatttgttacgactgattggcacaagttgaagatttctgtcatactctttagcaatagcacacgtgccgttatactcgggatgtatttcggacaagctgtaatccgccaacacggcatcaaagattatctcttttttatgatttataaagatattcataggtgagatatcgaaatgattaattctacatttcagatttagaaaccttacagcatcagctaacttacaaaacacactgtaataattcattacattcctgacatcccaatcttcgaacttatagagatcaacatcataagtacgtgacaaagacactttatgatccatacaaacggaatttgaaatcagaaggttattaataacacagtcgtgagataataagtcggctcccgattttccacggatgacaccggctatgaaagccgaaatgacactctcgtcttcgttggccgtctttatggccactttatctagatcaaacaccttcccgtaggcacccactccgagaactcgagccatagtcttttcaggttgacaaaactgtccacaaagttctttgttgtgagggacgtaaaccactgaatacgaacgctcctcgctttgcacgtcaaacaaaaacggcgagctgatcttttcgaaaattctcaggttacacaaagtctcgccgtaggccacaagttcaacattctcgctcatgtctagaaatatctgctttgaagctataattttctctagctccagtttccatttgtctgagctgaacatggtgtgggcattcgacagtttcatcggcgagtctaaaagcgactcgtgacaaagcaattcctctatcgcagaacaatcgcaagcagtttcgtgtttacattttccgaaactttcatcgagagcagaagcacttcgcgacttgcatccaaactttacaggcgaagaaagtgtttccatatcgctgcaggcggggatctgtttctttaacggagaactatcttcggcaaaaagttttcgtttaacaccttttccaagtccgtcatgttttctcaaccttttcctgtctggtggcaaatttatcggctgagttttttgaccttgaggtgtctccacaccgttgtccataattattctaattcagtgcttgccataagagtttcttttatattattactgaccgctttcacttccgccgtcgtatcaattatttcatcgacgtccaatttctctagctgctttaaagctctttgttgcacttttaaaaaactcttctgcttatccaaaaaaccactcaaagaagatatgacatgctggtgttccgcattgtccgatttaatgatctgcctagcggcgatcatatgctgatgcacactcaacggatgtctctcccctaatctaatctttaaagaatctcgatgtctcacctccaaatctttagaaattgactgtctcagatagtccttcaaagacattatatatcgaatctgacgctaccttccgaaatgacaagtgcactgagcagcttacgaaggtcatataccggaaatatcgctgagctctttgtacctggcagcatctgagttgtagaaattgtcgtctgcacgcataaacaatcctttattataattggactaaaaacagaagtctttaagtcaccagaaacgtattctagactaagtttgttttgtttatataatgcacagaagatacacatctgtgacgctaccggtaaaacagaaatttcttgctccgaaaacttctgttttaagtcgtacaggagtgacctgattcgacgacgagcgcgttctgaaatctctagcgctgaaaaatcaaaatctgagtaccaagaaaacacgtaagcttgcacaatgccaaaaaacagtccattattctggccgcattcgtacagatacggaggcaatagattcggaaatgcggcattatatcccgtcttactgtatccgaaacaactgtctgactggcaaaaacttttagggccacagaacaccaaccaaagtaaacattcaagatcacgcacatcggtataccctaacagattaggggtctcggcatactcaagaatttgtttaactaacttcgtcttatcgagcatcaaagacgtttcaatgtgtttttttgtatataaaatgtacgtccccgaaatggcaacttgttgatcttgagtccgcgaaacgttctgcagcaaatacgttctagccatcttttttgattttttgttcgcaaacgacaaagccaaattatccagagcggcatcgatatttaactttgtttttttttcaccagacggcacacccgaaggaataacgctcgtcacaaacataaaattctgtgtaggcgtttcgatcattctcaacctagcgctcggggctgccgaactacacactgaaaacgcagtttttaccgcttcggaaaaaatctccttatcctgctctgtgaggttcgccgccgcctgatagaccgccgccagcgtaaggtcgggctccatgctacgtacctgcgacataacccacataaaaaacaactatgaagcgatcatatggaaaggcgaaagaaactgttctacgatatctaccaaataccccaacagtgccatcttctataagaagcgttttataatgctcacgccagaactcgggttagcccattcatataaccaacaggtaaaacctctatatacattctgtgaaaaacagcgacatcttaaaaaccgtaagcctcttactatactaccgagccttacgcgcaagctacaagaaatgaagttcttacccgcttccgacaaatcctttgaatcacaatacacagagtttctcgaatcctttaagattctatatcgtgaaccgctattcttgcaaatagatggttttatcaaagatttcagaaaatggatcaaaggagaattcaacgagtttggagacacgcgcaaaatacaactggaaccatttcagaagaacattctcatacatgtaatctttttcatcgccgtcaccaaacttccggctttagccaatcgtgttatcaactatctgacccacgtgttcgacattgaattcgtaaacgaaagtactctgaatacgctgaaacaaaaaactaacgtattcctagtcccaagaagacatggaaaaacgtggttcatagttccaattataagttttttattgaaaaacattgaaggaatcagcatcggttacgtagcacatcaaaaacatgtatctcactttgtgatgaaagaagtcgagtttaaatgccgccgaatgtttccagaaaagacaatcacatgcctggataatgtaattacaatcgaccatcaaaatataaagagcacagcacttttcgccagctgctacaatacacacgtaagtactatcaattcaattttattttcagaaacaaaaaattaatacagaaaataacgcacacttagtccattaccacacgcttacacacaggacatgacaaaataatcagcctgctcagagctgagctgatcctgattggcatccaattaacacattttaacgcacaaggctcgtcgccgatgtacccatgaacgtaagaattaatgtcaagtgataacggtgcttttttctcgggatacataatatctatcttattaatttcctgatcacagagcaaagagattaactccggattgttaatatcagtcatttttttttgacacggtgtgtagcaaaaacaggtttcttgattagagacgcaccctacaatatgtccggcttgcgatacatgtttgttgtgatctttacaaaagacgcaatcttcggaatcgcaagctatcatatcaaaaacaatttttgccagagatggaaagatggttttgtcataacaagctacgtaaagatcgtaaacgagtacgaaagcatagatatacagatcgccaccatttttcagacaccatactccacacccacctaaaggaatcaatttattgtccccgggcccttttactgtgaggcgacttgcctcttcgggacacacaatagagcaattttcataaataagctccggtgtaacacaatgcatgcttgtaacacagtcagaattatattttgggataaagctcaaatccacagggcttatgcttcccaattccaatacatagtaacagagcccttccgcaacctgtttcttcttaaatttcattattccggtcaaaaactgtccaaaatgtatgccgtttaccgcaaggctgaacataaattcatgacttcgcttgagcactaccatctcgcaatgcatgcaatatttcttaggcttattcttcaacgaaaatataggagacgatgtcgcaacgctgcgatattcgcgatagaatgtttttttacaaatcctgaaccagttacattcattctgcaaaaaatttctaagataacccaaatcgccaattgaaaaagtcgatatcgccatcagtaagagcgaatttaccggtgattgcaaaaccgccgggtagcacaaaatccaactctaacttttcagatacatacaaagcacagcaatcaacatataattcccacgacttattctgtttttcacgacgcgtcgaatataaattgttagtcgagtctaaaatccattggatcttttccccatagatcaccgatcctttagaacagtctattaaatctccccaaacttcatcttgagctaaaaaagattttctcccgtttcgaaaacctaggaaacagataattgccttaataatgcagctgtctaaagttaagtttaaaatccaaaaatctttcccgagctgcataaatgataatagatgttcaaagctgaaattaactgggaaattgcaattaaatttctgtttaaattgcctattatgaatctgaagcgttttcacgatgtgtgtcaataccctgctcccaatatctcgcaaataccgatcagttctatcccaaaaatccgcagcgttaacccgctttagctgggaagcggacagtaaattattctcgatctgcatctcgcgggaaaacgaaagctcgtaccaacataccacgactcgatacgtttgagtaaaatccaatatttttttgcatctgaccttttgttcgaaccaactatcgcttaaaaaagattcggtcattttttcgttgacatgagcgggaatctgcatcggctttgcattgccggttgcctttaagcctctgacggtagagggtggctctaaaggtccctgctgaaaaaatagacaacgtttttcctcatcgggtgtttgtctatttccctgtgaagttagttgatagaaatcaataccaatatttttagctgatacttccgacggccggtctgacgaaggtctgatgcatatgagatcgtagagcctcagcactatttctcggtgcactaactgcggataaaccaatttcaaaattacagaatcgatatcaaaatgaaaatctactatcggaattggaatagtcattaccaccaaaccggtaaaaagttcgtcaaagtcagcattctttaacacatctttaaactttatttcacgtgaaatcacagtaaactttaatttactccattcagtataatgcatcccattcttgaaaaatacacaccgaaaatataaagactcgatacaatccactctcatcggaagatacgcatctgtcggcaggcaaatatgggccggatacactccgccttgatattggtacagggtgtcatagtataagtgcgtttccatactccaatctcatcttttttagtaaactgtcttctcgtttccgacgactgacgcgaattacattactgtcataaatcgttcctttagcgtgtcctcctataatcaactgaacaaaaagccgacttatcgtcgtcaaaggaatcttattgaaagttgagttcgtaaaaacagcattaaaagtataaaacacggcgtcttccacgttttttataaattttccatctttaataatgctatcaataatggcagcatatcgttccttgttttccatcagaaaactatatacataagataacaataccaccacgacattaaccgtttcgatattcggctcacagattggttctaagaaacagtcggcatatgtaggcatccaaccgctataaaataaacccgttttcgcacagacatacccctcatgcgtgttgacaatggtacagtcagtttgcatatcacagtggtgaaccgtcaaacaccgcatacagacaaacacgtttccaagtcccaactcaaacgtgataggattatgtaaattatacatctgagaacattcggttgtgcacatctggttattcttatgtgtcaatattctgcccgttaccctgtcgtattttcgcgggaacgccatctccattttgtcgatatattacatcgttaaatatctccaccgcgagattatcaaataggatagccgctgaatccaccctccgaggcaaggactcgacctgttccactataaaattgcaatttttgcttattttatcaattattttaaaaaggtcgtttttcgtttcacagttctcaaaatcgtcttttatctcgtttaacgccgaattcattcccctctcagagtatacgcggacaaagcttcaatctacttattgtcgacgagagccactttataaagaaagacgcgttcagcacgattttaggtttcctgccccaagcatctaccaagatcctatttatatcttcgaccaattccggaaaccattcaacttcttttttaatgaagctgaacaactctccgtttgaaatgctctccgtagtttcttacgtatgcgaagatcacgcccatatgctaaacgaacgcggtaacgccacagcctgttcttgctaccgactccacaaacccaagttcatcagcattaacgccgaagttaaaaaaacggccaacctcttcctagaaggagctttcatccatgaaatcatgggcggagccacttgcaatgtgatcaacgacgttttaattacggaacaaggccaaaccgaattcgagtttttccgatacagcaccatcaataaaaatctaattccttttttaggtaaagatctgtacgtatacctagatcctgcctatacaggcaaccgccgtgcttctggcactggcatagcagcgataggcacctatctagatcaatatatcgtctacggcatggagcactactttctagaaagtttaatgacgagttccgacacagcaatagctgaatgtgccgcgcatatgatattgtcaatcctagacctacatcctttcttcacggaagtaaaaatcatcatagaagggaattccaatcaagcttctgccgtaaaaatcgcatgtatcataaaggaaaacatcacggctaataaatctatacaggtgacttttttccacaccccagaccagaatcagatagcacagccattttacctactcggtaaagaaaaaaaactagcagttgagtttttcatctcgaattttaattcaggaaacatcaaggcatcacaggaattgatatcgtttacaataaaaatcacctacgatcccgtagaatacgcactagaacaaatcagaaacattcaccagatctccgttaacaattacataacatacagcgctaaaaaacaagcctgttctgacgacttaattatcgccataattatggcgatttatgtgtgctctggaaacagttcagcctctttccgagagatctaatcacccttcagacacgctaaaaacagacgaatcacatccgctctcgaagcctcgacgtccacctggaaaaactgactgacaaatacgagagctgactgaaagttatattcttctgtaaacaaggtaagcaccttagtcgcacacacaaaaacagagagaggagcattcacataagacttataatattcctgaactacacgatgaacgatttcgtggcttctttctacggtaggcagggaaactttgtgtttataaatggcattgaagatgacagcgagacaataacaattattcaccattactctgtgttgaatgaacgcactagacatcaactccggcctaggacgtacagagccagacatctcttcccacaaaccatcagcccccagctgaaatagacacgcctgaacgaggacaaagttttccataatatttccttgaataagaaagacttgttgtaggcgagctagttctgcacatttttgaaaaatctccctctctgtccgcgctacgatatcaacatctaacccgagcacatagtaaatatacgacaatctctctctgaaaatagacaactcctgcaccgacagaagcgtatctggcaaggtaaaaggagaggtttccaacacatctgttaaaacgtgcgtcagcaaaggcttattcgtcgtcgcgatacccacggcgtgcttccacttcagttccaggggtgttgactgtcctctcattaaaaataatttcggaacttcgtataatctatatcgaccatcggcaattctctccccgcactctatcgttatttttacacaatgtaaaatacccgtcaatgcgtagattatgtctccgtacacgtgccaatatatggtaagtttaccaacattccgattaacacaaccagaaataaaggcgcacagatcggacatatagaccgttttcgagtgcaagttaagcagtttacttaaatccgaattgaaaatttcatggacagctatggtttccgaatctaacctaatcgcgcaatcgaaccattcgtcggccatgggtacattcatgttttcatattagtcgtcagagtctgaagtaatctggcgacttcattccgcgtatttatggcagttgaggtttccgctaaatattccaacagtttaatgaaaacagttttatttttatgttccccacttttaacgataaaacgcaacacggcaagcgaattagcatttcgtcccatgtgatctagcttcattttcttctgcctagcaatgattttcggaacattgttggcgagccgcgtcccaaccaaagcacacccgtgtttgatttttgtatttgctacggagttcttattaaaatcaaaaaggccattcgaaattaagtgtaacatgatatcatgcaccttgttacgccgagagtgcccgtaacccattaacaggccaagacgtaaaaaaataagaaactgtttaacgagaaacggaatctgatgtagattccgctgttccagcaaaacaagcaattgatgcaaatccatatcaaagactaaccctggaatctctcgaacgttatttaattcctgaagcaaaacattttgaaggtctttgccagacacccgaggaataatacctgttcctgctttaaaccatcccacattcactttgttggcattagaaatcatgcacggaaagttagtgatccaatacacctttttctttctatttctcacaacatcttgatcttccagtccctgtaaatccactgaattattgctattgcaaacgaacgccggcaaaaacagatcttggatagaaacatgcatcttataaacgcctaaggcatataaaaagtcgcaataaggtccacgtatattgatattcaatgaactcatatctaaatcatcatttgaaacaaacgtgcttacagtaaacgcaggttctttaaatgtatgcttgtacatgacaaaactgtgagtcattgtcttaggaatgcgatgatacacaaaattagccctttttgaaatggttgcttttaaattcatgactttgttcgtattaaacgcgttaagaattaccgcgccatgcctcactgaggtaatttcagcaaaatcaataccaccggggacattaggcaactctttacgtttaggcagttgtgccacgaaggtaaaatctggtctcacgcctggcgggaccgcacttcgagactgcttaaacgacaatctcgaaattacccgtatgtaatgagtcgtcaaaacgttttcttcgtttgttttgcattcgcccggcaaactgtaatcgtaatacaacagaagcaaatttcgaaatattaactgagaagattcaacgacatacaatgttttaccgtaaacaaaaccattcaaacacagttctcgcttatttttttttaccgtaaccttaatatttagatacaagagttgctgtttaaattttgccaaacaaaacctctgtattgcaggaaccgccttagacgacattctcaaagtcttgatggcgtattgtttatagttttgaattttctcatagactacattaaagaaatctgttgtcacccggttatgtttgactacggttaaccaaagcttatgcaattctagcataaaaaaattttcccagaaccacgaatcaacagtgcccatatgcggcttgtgacgaaaaccgaaaagcagtttaaaatgaattatgactcgctgagctactttaggaccaagaagcgaaattaaatcatttgtacactgctcaatctcaatgacagtaagatagcgacacagataacacaaaaaatacggatagtattctagatatatagaattctgcttaggaaacacggtcgccacatatctatcgctcatcgacaactcgcacgtacacaatacattcggtagatgtgtattccactctttcagagataataaacctctgaacacgtgtgaagcgtagtaatctttcataatggaaaacttaaaaaccggaatatcgctacagcgacatcgactggtatgaatatataagatcggacctagacatttacatccagatttcgataaatagtcgttggtgtcccactcttcacagaaacatggcaccgcaaccggtcctaacaacagacgacacaaggcaattttagccctgtctttatcgtgaacgatatttggcccagacgtttgaaaaattttctctatgattgactcgatcttttccagaactacaggcacagatcgcgctaaacgagtttcctcgtcgcgagacacttcagcggtcagatcacaggaatctataaaaactggaatcgaccgtgcacaagtggaaccaaaacatgaattaactattaaagtttcacaattaccggtgtgctgcataacgccgaaacatggaaaattggcaggcgaccgaaattttacctaaaatcgaagcacctctaaatattttcaatgacattaaaacatacacggccgaacaactttttgacaatttgcgaatttatttcggtgacgatccgagccgttacaacatcagttttgaagccttgctcggaatctactgcaacaaaatagaatggatcaactttttcaccacgccgatcgccgttgcggcgaacgtaattcgcttcaacgatgtgagtcgaatgaccctcgggaaggttctcttctttatccaattacccagagtcgccacaggaaacgacgtaactgctccaaaagaaaccaccatcatggtagccaaacactcagaaaaacaccccataaacatatcgttcgatttgagtgctgcctgtctggagcatctggaaaacacttttaaaaacacagtcatcgatcagattttaaacatcaatgcgttgcatacagttttaagatctttaaagaattcagccgattcgctcgaacgaggtctgattcacgcattcatgcaaaccttattgagaaaatctcccccgcaatttatcgtcctgaccatgaatgagaacaaagtacataataaacaagctctgagccgagtacagcgcagcaacatgtttcagagcctaaaaaacagattgttaacgtcattatttttcttgaacaggaataataatagttcgtatatctatagaattctgaacgacatgatggaatcggtcacggaaagcattctaaatgatacgaacaactacacttccaaagaaaacatccccctagacggtgttttattaggaccgatcggctctatccaaaaactcaccaacatactctcccagtacatctccacacaggtcgtctccgcccccatctcatatggtcactttattatgggcaaagaaaacgcagtgactgcgattgcataccgtgcaatcatggccgattttactcaattcaccgtgaacgccgggacagaacaacaagacactaacaacaaatcagaaatctttgacaaaagccgcgcgtacgccgacctaaaactgaacacgttaaaactgggagataaattagtcgcattcgaccacctacacaaagtttacaaaaacacagacgtcaacgatccgctagaacaaagcttacaactgacattctttttccctttgggtatctacataccgacagaaaccggtttcagtacaatggaaacacgtgtgaaattaaacgacaccatggaaaacaacctacccaccagcgtttttttccacaataaagaccaagtcgtgcagcgaattgattttgccgacatactgccgtcggtttgccatcccattgtccacgactcgaccatcgtcgaacgactcatgaaaaacgaaccattgcctaccggccaccgcttttctcaactatgtcaactgaaaattacccgagaaaacccaaccaggatcttacagaccttatacaacttatacgaaagtcgacaagaagtacccaaaaacaccaacgtcttaaaaaacgaactaaacgttgaagacttttacaaaccggacaatccaactctgccgaccgaaagacaccccttctttgatctcacgtatatccagaaaaaccgagccacagaagtactctgcacgccaagaataatgataggcaacatgcctttacctctagctccaatctctttccacgaagcccgtacaaatcaaatgctggaacatgcaaagacaaactcccacaactacgacttcaccctcaaaattgtcaccgaaagcttgacgagtggctcgtacccagaattggcttacgttatcgagatcttagttcatggaaacaagcatgctttcatgatcttaaaacaagtaattagccagtgtatttcttattggtttaacatgaaacatatacttcttttttgcaacagcttcgagatgatcatgctaatctctaaccacatgggtgacgaactgatcccaggagcagctttcgctcactacagaaatcttgtgtcgctaattcgcctagtgaagaggacaatctctatctccaacatcaacgagcaactttgcggcgaacctctggtgaatttcgccaacgcattgttcgacggacgtctgttctgcccgttcgttcataccatgcccagaaacgacacgaatgcaaaaataacagcggatgatacaccactgacacagaacaccgtaagagttagaaattacgaaatctccgatgtgcaaagaatgaatctaatagattcaagcgtcgtcttcaccgacaatgacagaccatcgaacgaaaacaccatcctgagcaagatcttttacttctgcgtactcccggcactatcaaataacaaggcctgtggcgctggcgtcaacgtaaaggaactagttctagacttattctacacggaaccgtttatctgtccagatgattgtttccaggagaatccgatcagcagcgacgtcctaatgtctctgatacgagaagctatgggtcctggctacaccatagccaatacatcatctatcgcgaaacagctgtttaaatcgctaatctacattaatgaaaatacgaaaatactggaagtggaggtctccttagaccctgcgcagcgacacggcaattccgttcattttcaatcactacaacacattctatacaatgggctttgcctgatctcaccgatcaccaccctaagacggtactatcagccaatcccatttcatcgattcttctctgacccgggaatctgcggcaccatgaatgctgatatccaagttttcctaaatacatttcctcactatcaaagaaacgacggcggttttcctctcccgcccccattagcattagaattttataattggcaacgaacaccgttttccgtgtactcagccttctgccccaattccctgttgagcattatgacgcttgccgccatgcactcaaaactgtctcccgttgccatagcgatccaaagcaaaagcaaaatccatccgggctttgcggccacactagtccggacggataatttcgacgtcgagtgcctgttgtacagctccagggcagccacatctataattttagacgatcccacggtcaccgcggaagctaaagatatcgtaaccacttacaacttcacccagcatctaagttttgtagatatgggcttaggttttagttctaccaccgccactgccaatcttaagcgaattaaatcagacatgggaagcaagatacaaaaccttttctccgccttcccgatacacgcgtttaccaacacggacataaatacgtggattcggcatcacgtcgggatagaaaaacctaatccctccgagggcgaggcactaaacatcataacattcggcggaattaacaaaaacccaccctccatactgctgcatggtcaacaagctatctgcgaagtcgtactgactccggtcacgacaaatattaactttttcaaattgccccataaccccagaggcagggaatcgtgtatgatgggaacggacccacacaacgaagaggcggctagaaaagcattgtacgatcacacccaaacagacagcgatacatttgccgcaaccacaaatccttgggcatctctaccaggctccttaggcgatatcctgtacaacacggcacacagagaacaactatgttacaatcccaagacatacagtcctaacgctcaattttttaccgaatctgacatcttaaaaacgaacaagatgatgtacaaagtgataaacgaatactgcatgaaatcaaattcatgtttaaacagcgatagcgaaatacaatactcgtgctctgagggcacggatagcttcgtaagcagaccatgccagttcttacaaaacgctctgcctcttcactgttcatccaaccaagctctattagagagtcggtctaaaacaggcaatacgcagatcagcgaaacccattattgtaactacgccataggagaaaccatacctctccaacttattatcgaatcatccatataaaatggaaaccgtctactgcactttcgatcacaaactgtcactttccgatatcagcaccctctgcaagctcatgaacatcgtcataccgatcccagctcaccaccatctaataggtagcggcaatttaggtctttatcccatcgtctcctccaacaaagattacgtccacatccggaacgtattacggaccatggtcgtaaccattctgcagaaggtggaaggtaatcaactaattttgagaaagccgatgaccggccagcagtatgccataaagaacacaggacccttcccctgggaaaagggtgacaccttgacattgattccacctttatcgacgcactcggaagaaaagctattgaaactgggtgattgggagctcactgtacctttagtcgttccgaccgccattgcggccgagatcaacatcagattgctatgcattggtcttatagcagttcacagagaatacaatgagatgcaaacaatcatcgatgagttatgctctatccaatacagagacgtactcattaaattaccagacatagtcaacgacaaacaatcaatgtactccatgaaaacagcctgcatctcgctgtccatgatcacggccatggccccagacatcgtgagaacttacatagatcggctaacgctggaagaccattcaatgcttttgatcaaatgccaagaactattatctaaaagaacaacgttaagcacacagcgctgcggacaacttcacgctacggacatcaaagacgaattaaaaaaaatcaaatcagtcttaactatgatcgaccaaattaattctttgaccaacgagaaaacgtattttgttgtctgtgacgtttccgcagataatagaatggctacatgtatttataaaaattaaatgctttttaaaaacacactggcctactatgacttttctatcacttatacgcaggattataaaaacacaccccgcctgaacacccgcgtcctccatccgtcatgtaaaattacctcatcccttaaaaaaacacagtatttaaaaagcaaggtgaaacataaaatgtttttttgtaccaacatgtattctcctcaactaaatcatgtcttacagcttgtttttgattgcaatcacattgttccgaattcttaccaagaaatcacgttgaaatgtcgaatctcaagcacaaaaccaggaatcctattcataacagatggcactgaatcagaaactgaggacgtcctgttcgatgtacagtttctcgaaaatacaatgactatcaaaataaaaattttacctatttctaggacagttcccgtacggattcatttattctccatacccatttatctgccgtcacctgcactggagattgacgacatcaatgcgctatgccaaaaagaaaacatcgatccaatcgtatacgaacaatatggcctgaccaacatgccgatctcgacaaccaacgtgataaatcaatttaaagtcgtttcgaatgatagcgttgaaacgtctttgatcttacttaacctaagctggacagaaagtccttatcagtctcaaaaattagaccgctatggcagaaagctgctaatagtttttagcgcgttcagcatcgataccagaaaatgttcctattggaaaaacctattcgaaagtatgattccactctgcagagtcaacatgatttccgaacccggcatttctatctacaaaatagaatttaacgatccttttctcacaatctttttacgtaacgtagtgttgccggaaaacgagcgacggtttccaatcacgaaagaatgttatcttcgcttgaccttttcccctccgaatcggagtaccgtcacgctgaatatgaatatgccgtatttcaaaatctgcgcagacggaaagagtctagaggttttctttcccagcgatatgtccttagtaattaatacaaacaaagagatcacgctacgcggcaagttcactaacaaaaaaatcgtaggcatcttcatccctgttcagacgcatgtcttcaagctgtacccatttttatggtttgcccaagaaccgttaaaattgcggatttcgtgcgaaaaaacagtttccgtaaccgaacacgacatgttaggtcgtatcttttttgtgacgaagaagttgtttagaaagccgtttcgttccctctcaaacagcgacatgaaatctcttttaacacacacggagaataccgacaagccattcgaagtacacttcatgggcaattgttttcctgcatacttgctaccggaactcacactacatcctttagaatacgaagacaagcctgcgcgtggaaacccgcagatcctcccgtccgtggaaaaacactctattataaaaatgcgcatatgactctctacgtttacatcaactatttaacatccaaaatacactaacaggattcccctcatacatccagaaaagcaaacatgcaacccgccactctacaatggtcttcgtacgtactacagctaagattaacaactgccgccatattaaaacccggcgaactgagatattttaaatgcggattaggtatctgccccccttcatccagcgtggtgtgcacttgtagagacgaaagcagttttgcagcatcgccttttacttacatcgatccaaaagattacggcaacataccctttgcggtgcataacatctcagatctagatctggatctcggcagattacccatcgttcttaacatattcgcactcccttacgcgaacgtgactttatcaaatttaccggtgcaacgcatcgaagcctacgatcgccacgccataccccacggacagtgcgaggcgcagtttattctatatggccctctcacgcgcattaaaatttacgcggctgatatacgatggacagaaaaaacaccagaagagccaacacgatatttatttaacgcagatatatggatcaatctccaaaacactccgctcgaccaaatttttaactctgctaaaattgaatttatatcacaccgacacgtctccatctctagaatcttactttgtggaaatctattaattttgaagacagtgtacgaaaacgactatctccttgatgatactttttttcccgaaaaacttaacatacaactttcactgaccccccacaccgcagacatcacaatgtcgcagaatcaagaaacacttctaaaatgcaacgtcggttcaataactgtcggcgcaactaaaaatatcgtctctaacctgattacgcctttccattgctctttccacactatcttcgaatcaaattcaaactttacgggtttctttatccccaaactcttgcacggaatctctataaccacctgcatttgggacgagacgcggcctctctacatcaccatgaaagcacagaaaaagaactgtcgcatcaattactcgcaagaactaggcaaagtattcttcttccccaagcaaattttaccaccggggaataatatcgaattcagctggacagaaatgagcaacatttatgtaaacatagaatctccaaatggtcccgtaaaagacattgtagctctcgcaagccagccagtatcgcgagcaccaagtctaaccacggtcgcgcacgtaacaccagagatcagcatgggcatttttttgaaatcactccgcatcgcgttcgacaaagaacatttggtacccttgcacttttttctaaaacccggagaatctactcgcatggaattcatgccgcctgaaaccccacaaagcctaacgatattagaaggagacgtcggcattcgtttcataccttgtcacaataattactcccatagatcttccccgtaactagctcctaaataccattttatacgaaaataaaaaaccaaaacaacaacttttaaccatccgttttatttaacgcgtcggtaaacaattatgtgttaagtttcaccatgtccaggaattcactttgaaggaaatgtgggcattcgccatataccttgtcagtcataattctcatagatcttccccataacacgcacctaaacaccacttgatcacaacataaaaaaacacattttagctatccattttatttaacgcgtcaacaaacaatttcttgttgagttttagcagatccatggattcgttctgaccagcaaggctcctgtttaccgtttcaggcgtcaaagaagcgtttaaaatagacggctttggggacgcggcgcctttctcctcgatcgtaggtagagtctccatcggaacgacatgtctctgcggcgattgagcgcgaacgtgcttcaaagcattaatctcttgtcttaacattcctatcatatccaccaattctcttaaatcgttcttttctcgagccatctccttatcgtcgtcgttgtcaactttatggcgcctccttttttttgtatattccggatctcccgggaaacttaattcatcttccgaatcactctggaaatgccgctttttaaacgttttcggttgacgataaccgtgtaacacggccggatactggggaacgggggaatattgccaatagggatacattgcctgacaaggactgtgatatcgattcgactcctgttctgcaatcttagcagccgactccgaatacggtagcatttgatactgttcagtcacgggcggatgaacagaaacaggtggaactactttcggctgctgtccagttgtaacatttaaaagagaaaaaaaagcatctttcggtaaaaaaacacaatccgaaaacggtggacttgacagcaaaggggtagtatttggcagattttgattactcatagccgttgtagctgtcgcagattcaacggcgtcgtaattcccgtgcacaaccgacacgtcacacgtttcaaccgctaattcagacccaggttccgtagttaactgaacttgatcaccggcaactttgcccgttgctacaataatctccaccggtggttcactagctttaatatacgtacatttagacaaaccacatagctgtttatccaactgcaactttggaaaccgttttctaatataggatgtatccaaactatccgcgagcaagtcatataaatccgccgaaaataaattttcatcgaaaccctgagaataaacattgaccccctccaaaacttgtctcttttcactctcgctgatgcatgaaaacctatctagaatccagcttatttctcgtccgaaaatcgctatagttcccggtctccgaccgactccacatacagacacatgatgaaaaaacggtttaccgtctaaattttcatcctgtaaaactttgctagaaagcgatagaccaggaaaacttgaacttaaacactcaatttccgggtccggtggtaaaggttcaattaccgaacctgctgcgatcaactttgacttactagcaatatttcttatgatgtccatgaacgtttgagactgtatctgcgcaacgcagaaaagcccatgctctaaatcgaaaagaccacgtaccattccaatagtggccttttcgttgtgattaatattcaacggcaaaggaatatttccggaccgcaattctttttgaaccgtgtctctgggcagagctaaacattcttccgacggttcttcaccatagacacagaggaatccacctacccaaactttagacatcttgagatgacccagataggacagtacataaaactgaacgacgccgtccctaatttaatattacacataaccacaaaactgcttagaaacgagaatctgactagctttaaacaagaagaactacttttaattcaacatgtctgtacatcaatgctgtcacacggaatcaagatcttactactacgcgagagtttatacaattctggaatcggagacatagtgattttgaatcgcaaaatcagcaacaactactggtttcgactattttctattctgaaacagcattctgacgcggaactactccgacatatgtttaacgaaagtcactcagcatatatttcaaaaaagctgcactacagcggaaatgtcagtcacataattaattttctcttcatggacgagtttggtctaagtctcaaaattccggaagaaataatctgcgaaggcaatatagttttctccgttggagctatctataatcaccgacttttaaaaatctgcagattctttaaccgattttggggggatcaagaacgagaaccagcagtacggcttatctgcaaaacacctatggttcgcctaccttataatgtttggaaaatttgagatatccacgctggcgtacaatcagcaaagagccgagcacaaagccggactgttttcatttctccaaaacgactttaaagtcttctgcggcatgtctgaaaacccacagtttctcgacagttctgccatatttgaccttacaggaatcagcgccgaagatttattctcttatgaataaaaacgataaactccttactcattttaacatttttattccaacctctaaatccgaccccttttcgcgccgcgtacacgaaaaacatttcttacataaattgaccagccagatactgcacaaacgaacgggcacggtgtgatcatcacatgccatgcaataggccatagcggatatataataaacttttagaacaggaagcgccataaaaatatcgcgcagaccataaaaaattttgtcactctcaatttcacttaaggcagctttcggcagatgcgctattgtacccagcagcaaataaatacagagatacgtagtcacggacgaaagttcatctttcaaaagcatgaaatttttgctgtataggtaaaaaaacaccagcatgactggaatcacaaccgaataaaccaacattaaccacatgtcgtgtccgctccttaaaaacgcgagaaaacactgtccagtctcgttctgcaaagctgtggctttgtaattattcagcatctgaagagcttgcactcccgatacgacccaaactatcgggaaacacacctttgccagagccttggaattctcgttcaacaacggtgtgctgtaacagaagtagttgatgcgctcaatcgccataaacaccaacgaccacgaagagaaataggcagaaaaatcatcgatgtagagaagaattgcgcaaaaatctcgcggcaaagtccaatgtccactcagcaatcccatctttatcggaagtaaaaaacaattgaagctcatcccggcaaatgtaaacacagcgtattctcgaccgactttgaaaccattaaatctaaccgtcaggaaaaccaccgtacacaactggatggacgaaaaaatgaatacccagccataaaactccgcggtggctggccaagccaaagactttgtttctttctccatcccgaagaaacgaagcaatgattcattaaaagctctgtaagtctttatattcaaaaccccatccgtattgacgtaatcaacacaacaacatcccgccttatataatggccggtattggcagaaaacctaaaactagaaaatagatgaaatcataagtatcatttacattaaataatgaagaggccattgcaaacaatctctgtctcggtaatgtaaaagatagagtaatgtttaaaccgttttcaaaatgaaagagaatgcagtcatgcttttcaagtatagccacatccgcctgttgttccatttgtgcgcggatatactccacgaacggattttctttagattgaacctgaacggcatcggacggagcccctgcacacttatgttcccatcccaatctcacactctcatttacacacacggccacgagaccgggaaaaagagtcgaaattgatatgtcattctgcaggttgtacataggcacaacgtaatggtgcattaagtattcaaaattttgaatattcccagcttcaaagttattttcggcgaaatcaacattctccagctgtggaaaaatcgaagtcaggagaaacttcccaactctcttgttaaacaaactttctgagttcaagatccgccacaataaaaagagactttcaattgcaaccaagccagaccgtaaataatgttgatcgtgtataaagattggaacattatttcccaattttggtctcattagctgatacgtccaatacaccagaacatcattcttaatggctccgtgtaagcgagcttcaacatcaaaattttggctgtctttctcaccgggaattttttgcatcactcctctacctagcaacatctttacaagcacatgattcccaaatgtgttttctgcataatgcttgccttttctcatgggaacaaaaaatttcatacaagaaggatcattaaatccaaaataggtgccagaaggagagacatttttcaatgctgtaatttcactaccgagtaatctaaatatcacgggcagaagggttataatatctactagggttgtacgttcgtcgatctgtgaattctcataagtggaataaaaagctgccaggatacacaaggctgcttccaggtctgacatctcacttccgaatataggatacaccgtcgcttgctccaacgcattgacggtaactgttaataactctttcgaaatagtcaaagaatccacattagtaatttttaaagcccttcttaagccaggctcattgtaaaaaaccctcttgagcttataaaaccaagacccgaacgtaaaattccacatctgagcattattgaaaaaagtattgatcatttctcctctaaaatcgtctgtaaatcttataaaggggtcgagtggggttatggcaacttgattaaatttttccagcctctcaggagatttcggtaacagttgcgtatcagctttcgtttcgacgtttacctccccatcattcgtaaacagcaaagcatcctctatcgcttttaaatgagaattcaaaacgtcactgtctttttgcatctttctttgcagtgcgtctaattcggtttttaggcgcattcttagcaacttgtcgcgatgcccttgatctattttctcccgaagtcttagtgaggactgactttgaagccttctgatatcttcttctgtacaaatcagtatgtttctgacatgcccttctaaaattggtgtaattgggtattgataaaagagattgcactgcgccatcctgagacctagcgaacaaatcacatataaacgaaaatgacaaccgcttggtcttccccgaaaactttttaaaaaaatctaacttgagtccccactgcctgaaaaaacaaattacgggaacaacgttccacaaaacctcgtctgcaattaaatattgatccaagaacgaaatagactgatgcaactgtctcaaaccttgcaaatattgcgcctgatgaatgcagttgtgatgcacagactgcattgtcgacttccccaaagtcgtcttaaactcaaaaaaataacaatgaaaagcaaactcatctttggcatctacactctttagcaagacgatacaatccggaatgcgtggccctagacgcacctcgaaaaacaccgagacagatgccgatcgcaaattagccggaaacacatctcctaaaaaataatttagtcgcgcaaaatttccttgcaaagataagatctgcttatagatcctcaaatggtgaaactgtccaatttttttccgaatatcaggcaaacctgtcaaagacatgttatttgacggagaaaaaaagacgcggagaatttagaaacaattccgagttccataacacatcatttttgtaatctatttaatatggaaagatcaaaaagtgttcaactttcaaagaatagcagaaccctttcacacttcatcgatgaagaacaactatgctcttccgactctgggtctttgttctgttgactccctgttacagttggagaccgtggaccatatcgaacgagagccattgtaaaaatggaaactctgaaaatccaattgttcgcccgggctttataacttttaacttttatacaaaaaacgacactcggatatatcaagtccctaaatgcttactcggatccgatatcacgtaccatctgtttgatgccatcaacacgacagaatcgttaaccaattatgaaaaacgcgttacacgtttctatgagccgccaatgaacgatattttaagactttctaccgtacctgcggtcaagcaatttaacctggatcactctatccaaccgcagattgtctattccttaaacctgtacccttcacacggaatttattacatcagggttgtggaagtccgacagatgcaatacgacaacgtttcctgtaagctgcctaattctctcaacgaactgatctttccagtccaagttagatgcgctaaaattacacgctatgcgggcgaaaacatctatacccatttctttactccggactttatgatactgtacatccaaaatcccgcaggagatctgactatgatgtatggaaataccaccgacataaactttaaagccccttataggaaaagttcattcatattcaaacagacattgacagacgatctactattgatagtcgaaaaagacgtagtcgatgaagaataccgtttcatatcagatgcgacattcgtagacgaaacgttggatgacgtagatgaagtagaagctctactactcaaatttaataacctaggaatccaaaccctattaaggggagactgtaaaaaacccgactatgccggcataccgcagatgatgtttctttacggtatcgtacatttctcatatagcacaaaaaacacaggaccgatgcccgtgttaagagtgttaaagacacacgaaaatctcttgtccatcgactcatttgtcaaccgatgtgtgaacgtctcggaaggtacgatacaatacccaaaaatgaaggaatttttaaaatacgagccctcggactatagctacatcaccaaaaacaaatccattcccgtatctacgctgctcacgtacttagcgacagcgtacgaaaccaatgtaacgatttccaggtacaagtggtctgacattgccaacactctacaaaagatctatgaaaaacacatgttttttacgaatctgacattttccgatagggaaactctattcatgctagccgaaatagcgaatttcatccctgccgatgaacgcatgcagaggcacatgcaactactaattggaaacctgtgtaaccccgtagaaatagtttcatgggcccacatgcttacagctgacaaggcaccgaatctagaaaatatttattcgccttgtgcctctcccgtacgcagagatgtaacaaattcttttgtaaaaacagttctcacgtacgcttccctcgaccgttatcgatcagacatgatggagatgctatccgtatacagaccgccagatatggcgagagtagcggccattcagtgtctctctccaagtgagccagcagcttctctgcctctgccgaatgtgacatttgtaatttctccctcttatgtgattaaaggagtgagtttaacaattacaacgacaatcgtggctacgagtataataatcacagccatacctctcaattctacctgcgtttcaacaaattataaatatgcaggacaagatctgcttgtgctacgaaacatatcatctcaaacatgcgagttttgtcagagcgtagtcatggaatatgatgatatcgacggtcccttacaatacatctacataaaaaacatagacgaactaaaaacactgaccgatcccaacaacaatttacttgttcccaacaccaggacgcactaccttttgttagccaaaaacggctctgtttttgagatgtctgaagtcggaatcgatatagaccaagtatctatcatattggttatcatttatgttctgatcgcaataattgctttattcggcttatatagactcatcagattgtgttgaataaacgttttatttatatttggcattagatagatttgtccgtatacagctaaacgccgacaacgtgctcgtgaaaatatcgtcattaaatccgattagcgcccgataaattactagtaagaacattaagatagccagggcattcacaatcgcagtccagcacagcatgcatttggaggtcatcgtccaaccctataaaaaaagcaaatactattttagttacacattctccttgtaaaaattcactgtggtcaactcacccgacatgcttcacatctcgcgactcggcctttttctggcccttttcgcgatagtcatgcactccgttaatctaataaaatacacatctgatcccttagaagctttcaaaaccgtcaaccgccacaattggagcgacgaacaaagagaacatttttacgacctccgaaacttgtatacaactttttgtcagagaaatctatccctcgactgcttcactcaaattttaactaacgttttctcttggaacattcgagatttacaatgcaagtctgcggttaacttgtctccattacagaatttaccgcgggcagaaaccaaaatagtgctatcctcaacagctgcaaacaaatctatcgtcgctagcagtttttctctattttatcttctgtttgccacactatctacatataccgcagatccaccatgcgtagagctactaccgtttaaaattctgggaacacagttatttgacataaaactgaccgacgaatccttgcagatggcaatcagtaaattttccaactcgaatctgacacggtcattgactccgttcactcctgaaatcttctttaattacaccagctttgtttacttcttgctctataacacaacatcatgcatccgttcaaatgatcaatatttcgaacattcgccaaaacctataaatgttaccacttcctttggacgagccatcgtaaactttcattcgatactgactacgacgccatcatcgacgccatcatcgacgtcagcgtctatcacatcaccacatatccctagtaccaacacaccaaccccagaaccttcccccgtaacaaaaaactttacagaactgcagacagacaccataaaagttacaccgaacacacccaccataacaacgcaaacaacggaaagcatcaaaaaagtagttaaacgttcagattttcctcgaccgatgtacaccccgactgacattccaactcttacaatccgtcgtaacgccactattaaaaccgaacaaaacaccgaaaaccctaccgaaaacccaaaaagtccaccaaaaccaacaaattttgaaaataccacaatcagaattcccgaaacgtttgagagcactacagtggcaacaaacacgactcaaaagctcgaaagcaccaccttcgcaacaacaataggaatcgaggaaattagcgacaatatctattcttcaccaaaaaactctatttatcttaagagcaaatcacagcagagcacgacaaaattcaccgacaccgaacacaccactccgattttaaagtttaccacttggcaagacgcggcgcgcacatacatgagccacaacacggaagtacaaaacatgaccgaaaattttattaaaatttctcttggagaaacgatgggaatcacgcctaaagaacccacaaatcctacccaacttctcaacgtaaaaaaccaaacagaatacgcaaacgaaacccatagcacagaagtgcagaccgtcaaaaccttcaaagaggacagattccagaggacaactttgaaatcctcaagcgagccacctaccgttcagacgttgtctgtcactccaaaaaaaaaactaccgtcaaatgtaactgccaaaactgaagtacaggtaactaacaatgctttaccatctagtaattcatcacactcaatcactaaagtcaccgaagaaccaaagcaaaatagaatgtcggcgtccactcacggagagatcaaccacacagaaataccacgaatgacaccaattcttaacgctcacacatgggaaaaatcgactacacctcaatggcccttcaccgctgaaacgtccttaacgacatcttcaaagtctgccattctaacctggtcaaacttactaacaacgccaaaggaaccattaacgaatacaagtctaaggtcgacaaatcatatcacaacacagctaacgactagcaacagaactcaatcagccaaactaacaaaagctcacgtctcgtcacaaacgactaacatctacccccaaacaatcacggaacgatctacggacgttaaaaaaaaaagttccacagaaagtcgggaagctaacaaaactctgcctggaaacgactaccgcgtcaccgataaaaactcacacaaccatccagataacctcactaccaaagcatactcaacccaaaatgcaacgcattacacatacaacgaacgacacgatttaaacaacacagatagcacataaccgcatacgtttgtcaaagctactcatcctcagtcttcaataaaaactcaattctgaaatcaggtttgtcttttgtcgttatgaaatctattggagataataaaacacgatccaattacatcaaaaaatgcttttatttgtcgtgtgctacatttataattagaataggcgtctcatgcgatctaatagcccttcaccgtctctgaagcaaaagtcttataacaccagtacttcaagaaaatcgcaaaagaacacaagagtaaaaaaagatttatcaaaagccagatcgaagaaaatgaattcaagacgatctcataggtgtgcgaatggcactctgaagaataaaagtccatttccgtagcggccgcaaaaacaagaatgtaaaagagccagagactgacatataagcgttgccttgcgcctttcttacaactcatcttaagtgttattttgaactagtcttcgcgtcgacgtgattaacagcagacagccctctgtcacctggaaaaatgtacagcgtaatttcagaaaagatctctgaaacgattaccctacagagacaaacgagctcaagatacattgaatttttcgtctttcgaaacgtggacatcaatgaactttggactacagacatatctgaagacaaaacgcacgatgtgtggccagctataaatgagaaatcatttaaaaaatttctagaaaacgaactaacctcttatcaacgcccaatctcgcttctaggtattccgcaaaatggaacagtgtcgaagacctgcaaaagagaaaagcaaagagaaaccgattgtgttaactatgtaaggaaacatggcaacccagtaactttctacccaagacaccgcgcaaaaagaaatgcaaatacggacacttgtatttcggaagaaccatctatcttagtaagccatcacaggaatagtaaaatggacgtttttatggacgccaacaaaatcacactcgtaaatagagaactcatatgggtgccgcacgatcaagttcgaatcgtaaaactagatatttccctgtgcatcccggatggtttcttcggagtcattattggccatagcaacgacgtattctgcgaatgcatcactgaaattataaccgacgaaaccgacatttcagtttttctaatgaacttatccgagcactccctaatgcttctcccaggagatgtcgaattctcaatcaactttctcccttgctacatcccggaaccatgggagatgatcaatctgtctccccccgaatctgcagttttccatctaaagacatgcagagaatttataattaaaccgaacagctatacgatacaatgcttcgacgccatgtacgtttgcgccgatgaactaaaggctctcatgattccctccaaagaaattatcaaactcggcttattgattgaaacctacatctggaacaaagacacaattccctccataaagatcttcaactctacacgcaaaactatctacatccctacaggcatctgcatcgccagaataatttttacttgcggacatttctgcctcagtttaatgcctgaacgcgcaataaaccggctacaggtactagacgccagttcctttttcttgtttcattatgccgccttcagtaacgcttgaccatacactctcaccttcagactcgacgtgtatcgatttaaccttttcactcggagcttccgtcacaacatttggcagcgcttgatataatcctgtctcctcatggagaatcggatccaactctactaaaagacgcttgctgttttcgccatcaatctctatgagactgtttattttctcgacatcgctaagtgttgactgatctgtagcgaatttgttaagcaactgattaagattatcggtgcacatagaaaactcgccaattaaagttttcataaaaacgacatccatcgtttgtaatattttttcagctttcataagctctacacagagtgcatctttaacgtggttaggacaattggataaacatcgctccataatggtatgcctgagcttagtttttttgtacattggtaataaacctaacagagttttcatagtttccgtgtctttttgatgacttataatatcattctgataaactccaaaatctttatacgtcatatccagaaaatacgtcagctcttcactttctaaatcgtcggaagagcacaacatctcataatttgcctgagtcggctgtccaaacagagataatcgtcgaaaacaatttcccataacaccccaataccctaagggcatttaaagccaaattcatctgtaatcaacagagctctacacaatgaccatcgtagtgtttgcgactgaatacgatgccgcaaacgtcatttttagtatcctatgtagaagtcccagtgaacatttaatctttccgattattgttaaatataaaccatcaaataacgtcagcttctgccttcaaactcaaaaatgcaaaaattcaaagcgaatcgacacggtattcgtctgccacgccgagaaattaaatctcagccactacatacaaactgcaagtccgataaaggctgaagatgttgccaacagcctcaacgacaaagaaaccgaattgttatatgtcgacatgatattatctcaaactggaaaagaaaaagaggacgtcgaatttaaatacatggcctatttccacaaatcgctcattatcaaatatctcaccggtaaattcctattgcccacttcccccttttggtttctatcgacctacgggcaaacagaaggtctgcttttattaacgatgtattactatttgttcgaggaacaaaagagcaccatcacaactaccaaaaattatgttcaatgctttacggaaaacacaggaagcatggtgttcacgtattcttccatgtccgaatttataaacattactttgaaatcaaaatttagaaaactatttgcagacttcgcaacgtacgccagacaaaaaaatctccgcgataaggaagaatttaaatatctagacactcaaatcaatctatttagaaagagttcacatctaaccaacacattccgtgtccattacatatatatcgcttacaacacggccctagagacgacaaaattcgtcaattactgcaatatcacttcttacgactctaatttaccaataggacaacaatgccagagaaatgtccacattcttggaaattccctgcacgaaaatttactgtgtatcatgaagcaatacttcaatgcggattgttactttaaaacatacatcgatataaaaagactgaaaaatccagatctaaacgttacagaatacgagtatgctctggcctctaaaaagaagaccatccaagcattaacttccgaacaaataacgcgtgccatagcgaaatgtaataaaaacggagaaggtcttttttctccagtaaaaccaggattacaaggattattagaaatctccgcttccgataaatacgttcagatacaagataagcgcatctacagaagacaacacctacacaaagattatcaccgtccctttcctgtattcagagtgcagcttttacataaaaatattttttgcttcgggaactctgaagattggtacgaaaacatgggatttaaccgcatcttacagtatctccccgacgaatatatctctgatgaagctctaactcgcgccatctggctacaagacacacattttctctgcgacgacttcgaaaaacaattctatactacacgacacgaaatattcaacgaacgcataccagtcacaaattacataggagacttggatcttccgctgcaagatacagcaaccattacggaggaaacatttttctcgatgtgtcgcctcataagacttaccctcatcaacgcctggaaaaaaatttttccaagcatcgacacacacacacatcccatcttcttcttcaaaacccagtgcgacacgactaacgacgcactagactatactgaagatccaaccgaaatcaaacaattctgtatttgtcggaaaaagatcggtcttagaatatcaatcccattacctaatggcacagcgatcgccgggggagaaccattaaaacaattatccaagattttaaatcacgttatgtgtttagatcaagagcttagtcagatcctcaattccctaacatttcccggagaatgtttcgacatcggcatttaccacacaggtcactgcatcagaataggctatatgtacaagacagacatggacaaagggaaaatgctacatggacggctaactcccatatttatcgtcccagaaggttaccgaaattcttgcaagacgtttattcagatgcaaatggatttaaacaaccttctacatcacggtactaagaaggctcccatcgaagaattaatctatagcataacggataaaggctgccctaaagaaaacctaagtttcatggatttaaaatccagacaactgtggaacaaagttaacatagctacagacactctaatcaccaagtacctgaacacgcatggttttaacaacaatgcaacatcagcggatgactcccttttatcgtttattagattaatcggatggccaatcattaaaacgcaattaattactcattacgagactaggatagcgcaacagttttcacaagtaacttttctcaaaatagattcaaagaaccttcagatcaaaaaaacacaatttggaagagtttcggattttagctgcctgaacagacaacatagaggaaatcgagataacgtcctagtttacatacaactcaaagccgacggaaatcggttaattctcatcttgtggagcacatgctttgctactaaatgccagtccaacagcaaacaagtacattgttccatcgccttagagcaattaaaaaactaacttactacctataaacccagaccttcttttagtatttaccatttgactccaacgcacatgctaactaaatcgcgccatatcacagcatttccggagattaaagcattagcaacaccgtccttcgttctttcacacaacttaaccgcaaaaaagcgccaacggaaagcatctcaaaaaacatataaagaggccaatttatgtcatttcatttattataagcaaacatgtatcctcgtggagtaaaacgctcacaacatgatcgtcataaacaaaccgccttcagaacgataaaacgttccatcacgcatagaccaaccagcaagttcatcagccatttcgccaaaaattttcgaggaaaactcgcacctctgaaacaactggatgaatctagactagacgcactaagtctgacagagttagaacagctgaagaccatcatcgaagagaaacaacaagaaaaacgcgctcaaaacaatgcaatcacctttctgcctaaccttccaacagtcccctttgccgacacaaacttttcgataaaatctcttggcctgagaccttacaacggagacgcccgtgatccaaaacaacgcatccgagacagatttccacagacgcatgaacgaatctgtctcctaactaatgacatactggaaaccgacctgctgcttcgctatcgacaatgtctcgactcgctcacgcgagaagaaaatcagcaactaatgggcgaccggatattctccctgaccaactcaccttgtcttgcttttacagttgctacagtagaagaagcctgcagttattttaaatttcacgatctgcacaacctaccggtcaacccacaagacttattcatgtataccatcaccgtcatgaaattcgaatttttcaacaaactcaacatggcgaaattaacctgtgttttcaacgacaacggacacggcgacatcgaataccgaaaactcaggcaactctgcggtaaacctgtactagatcgagagatgccaaactccgaatttgaagtacaacaacaaactccagactcatttagacacccaattcaacaagccatgtccatcgttgtgacgttcgctcgaatactacgacaaattaaagaacatatcatacgaacaaagaaaccgcaattcatccgcgatttcgacacagaacgtgtagccgagcgatacgaatgcggtctgataagcaggctcatcggaaagcaattcagcaaccataaatgcgatgatgtcagctgtcaaaatagaatcgaacgaatcatggctccttggaaaccaagtctatttttctgcacttatttcgccaaagacgcaccaaagtttaagctgtttccaaatcttcctcacgaataccgaaatctttcttttacttgtccaaaggtcgacatggaaccttcatgcagctattcaacaagtcgcgacctacctcagacctctcatcgttcacataaaaaccaaggtacgcctaaggttaaatccaaagtttgcgtcgaaaaaccagacacctcaaacctaacaacgacaaaaacaactaccgaaattctcatagaagaatcaatggaaaccgacaacaaaataccagatcctagagaactaaacttcaatcaagcaaaacaagacgaaattgtgattattaacattaatgaaaacgtcaactctaaacatgaaagtgaatcaagtgttgaaatggacttagatttagactatgaagctgacacctgtgaaactaacttaaacacatattcttctgactcagaataactatcttactgtaaacaaattcttacaagtatgttttgtacaaaggtttttgctgtcacactctgaactatttctttttaaaatcaaaaaaatctcgatgccaaagctttctgtaccccaagtgaaaatcgaaataaatattaactaaaatttggaagcctgttttagattctattcgtgaaactgtttttctttaaacggtaaattcaaactccgaaaaaggttcaaacaatgcaatcgaaaacgtcgtcataaccttctcgtcgcggctaaaaatgcgacaaagctattctaaataccaattccttatttctaaacacgaaatgaacgacttattacaatttgacattgcgttttgacatgagctaaaccatcgacttcaaacacctcacagtctagtagatatgaaaactaaaccaaaaaattttacacggacttatatctttaccgaaccatgatctaaaattgaaatactaaatacattcactgataaacacatagcaaacctcgaagaacttgctcttttaacgtgaatttaacagcatgctttaccatttacccgatttaaaatttattaatttcaaaaataccgtgaaaactactgtatttgtgaatgttttgtcactttgtgaattctacattttaaaatgcttaaattacatgtggaattaaatattgaaattctactgaaaacctcgaagagcttgctctgttaacgtgaagaatctaatagtatgctttattacttacacgatttaaaatttattaatttttaaaaaatatcacgaaaactactgtattcgtaaatatgttttcaccttgtgagttatacgttttaaaatgcttaaattacatgtggaattaatttttgaaattccgctgaaaagtttactgtcgccggcaaattaatttttttgtagaaaatagtacacgaaggatcattttcagtcaaacgtctcaagtcgtaccccagcgtccctctgaacagccggccgctcgcagcctttttaaatcctgttctgagaatgtataattaggctatgacgtaaacgccacgccttcgttctcccgtcctcaataagtttattaaaaaactatatatataatatactattgtacctgaggtggacgacgatttacataaatttaaattaaggggcgtgtcatgtcatctgcgtggaaaatatttgcataagaaaatcgtttttcttttgtccgtaaaactcatatagaaaacggtatatttcaacttgtggtttacttttatgtttgatgacgcgtgttatgttacgtcaaacataatatataaggatttcaccacaaaaacccattatctttgtttttgtgatcgaatccacaaagatggctgatgaaaacgaaacggtggtttctgctcctgtttctactgctgcttggatctatgtttttccaaaagagaaagaacttttggatgttttatctgttttatcgttaatggagagaaattctcctgtagttatttcgccgttgttaatgaatttgactgtagaaaacgatttctcgaccacggttaaaacacctatcactaactttggaggcacaattctaactaaaattacgtcttttatgcccgtgtgtttttttttccatggaactgagcagttagttggtatggccgaagatcatggtgatcttattcgattatgtgagcaaaccagacagaaatttcacttgcagtcgtttgaggtgcctacagcacgcaaagtaatcgatatcaaagctctttgttctgctgtcggcaaagatgcagattctgttatttgccatgttgcgtgtggaaacggtttcaaagagttgttgttcgctggtctgttaattccttgtgttgaagaacaaattcaagtacaagttggggagtattcgtgtgtgaaaattcctctatactctgcaactttatttgaaactgaagaaacgatttctttatcttcctgtacagaatttattcaggaacgaggattttttctgcctgcgttaagtgaaacgcttttttattatgtttttacatcatggggtacaacgttacgattttctaatactaaggaattaatcgatgctggcctgaaacaatttacacaggatggggagcaaactgtcaaattagcaccccacaaaacttatctgggtatctccggacagaaaatttcagcggtcgagaaagattttttgatgttggttgattccgttgtgacagaattatcgtttagtcatgtagccgaatacctggattcggtgtatgaccccagtcagataatgaatttcaatgactggccaatcataagaaactcagagacacacgctgaacgcatggcgcagctcacgaatttaaagttacatctgtctagtcatcttgccgttttgatctttgcgccaaattctatcttatattgctcaaaattggcatttataccaaacgtgaaacaagcgtttaattcggtgatgactcaagaattactgctgcgatctttgtctttttgtaatgcgttgtcgtctttgactgaggatgtgtataacgataatagaaaaatcatcaaatgtgattcgacatcaggcaaagatgacaaattttcagctaatcacttggcttatgcctgtgcgacttgcccacagctgctttcttatgtagtgtggaatttaaatcgtatgagcgtttataacgcgggtaatgcgtacactgaaatttacaatcatctggtaaattgttcggcgaatttatgtgaattctgtgatgggaaatgttgtcaatcgtgtattggaactgccatggtgcgggttggtactcgtttgccggcaataccaaaaaatgttaaaaaggaaccacttgttatgagcatgttttctcggtattatgccgaggttgatatattaggttcttttggcaggaagcctgtcagcgagctcaaagagattggaaaagatcaacaaaacacgctctcactggacaggggtaaatttgtatctcagatcttcgattactgtaaaaaaaattctttgattgatcctgtaacaggcgaagatactttcaatgtccgaagtaaaaaagattttgtttctataatccacggattgacacaatgtatcgaggaatgtgtttctagatgcattgttgaaatgagaaggacacaaacgcctagagaacagatagaaaattgtctacaatcatttaatgtagatacgaccccttatgcaactgcattttctccttttttgacgtttgcatattataaggtcattttaacggttttgcagaacctcgcattgatagtggcttcaggtcatgttgtcgacagaccttgtactggtaattcaatttctaaatggctcgttcagcagtatcaatcactgtacggaacgtttcacagcagttatctcaaaaagggttttctgaatacgagaacggttaaagtcgcttcgaatgttgatatggagcagatcttagattgcgatctatataaatcgggtaaatatgtgaaaactacgattcaggcgaaactttgccgtttgtctatgcaatgtcttcgagattttagaataaaaaacagaccgttcaacaagtccagtaagacagcacacaacaatccttattttaaaaagaacgtgaaacacaagaagaatcccttgtctggctgtatctcctttcttttatttaaatatcatgataaattgtttccgaatgtcaaaatttcgtgcttagagttatggcaacgttttctgctcaacaatgttccgaaaactttagatattggtaaccccgaagaagttaagacttttatcaaatttgcattcagtattacgaatacctatgatgagatagacattatcgacatacagccagagtgtctctcaacttttatagattgttactttcataacaagtttttgtcggctttaggttttcatgactacttgactagcttacatggtcttacatctaagctggttacgcagaatcctgtgttgtttcctgtggtgttagacaagcagcctaaattttcttctattcaggaatatttagtttatgttaaaaagttagttttggatggcgttccgaatcctgtgattgcgtcactgtccaaagaacccaattttggtacaatttttacaagtcgatctttggttacatttggtttgacattagagaaatttgtgagcttggctaatagggaatattttcagtttggccagttaggttggataggtggaagtggcgtggataggaacttaaaccctacctcttctgcattgcaagattttagatttatgaggcagaaaacgattattgctacaaagttctcagaagttatagtgaaaaaggttcggcgtgagacaattatgtttgatacggaagtggtcaagggcaaggttctcagcattgttgagaatttaactaacgatattgatccagaattattaataatagctgaggtgatgagggatagggaggacaagccgactatggatgatatgcttttttttgtggatggtagggaagctttagcggcatccataatgcttaaactgaatcacttagttgatatgaatgtgagagatttttcaatagctaatttgcagtcggtatttgaggcggtgtcttcaaacgatgctccggtctatgacttttctgaaattctagcggaggaggacgatcaagcaagcggtgtattaaaatgtgatgaaacggaaaccgaaacggatgagccgatgactaagaaaaaccgattataatcagagtatgaattcgttacaatctctgtgtgtgttgtgcgctaggcttaatgaatgtgctttggaccttgaatgtttaaagttttgtgatcctgtaatagtattgtctgatatggcaaatttcaaaaagaatgggattgtcattctgcatttatatcaaactttttttgaaggtatcaaagaacagaatcttctttgtgcgtcagctttgacggtttatatgcaggtgctgctaaaagctatgtatgaacaggtgcttcttttggatgcagcgttggaaagctttatggtagaccaggatagaaaaaaatattttgaaaaggtgttgtgtttgaaacgttgtgctgagcacttgtcaataaacatttcattaaataacggtgttgagtttatcgtgcaattatctacgctaaatgatatagaacaattaatcagtaagatcaactccgtatatgctttacttctgccccaagaagggttgcagatttgcggaaaaattatagacttgctaactatcatgtgtggcgcatgtatggttgcgaaaccggagagttatctcgaaaccaagacttgcatgaagtgttatgaagaattgactttgactccaaaccaaggaaaatcacttcggaaaagattacatggaaagttctgtaatcatttgaccgagcaaaaagctttttttaatattgaaaaaaatattgagacgatagaaaaagacttaggagaggccattttgaactatgggactattcagtctgttgtgactgaaatcaagaagatttttaagcagcagcgttcagccgaatcgttgcatgttagtgatgctgagaaaactctgaaaaagtataatatttttagcaaggtacctgacgtgatatattctttaagtgagtttacgtattggtctaaaatatcagaaacgatagtaagaaatgttgctattacgcttcagcagttaaatagttgtcatacgttgtataagcaattacagaatgatgttagtctttatctttacggtgaagtctctgaagacttcttggctttgagtgaaaatttgctcacgcatgacgagcgcttgtacgttggctctatttatgtgtctccttcgaggttgatagatcttgtcactggtctgagcattaaaaatctcgaggaaagtccaatatttaaaagattggctgaggaagatgaggttcaacataaaattaagagtctgttgcatgacattcgggatccacagacgacagaaacaccgggaaggctgaacacgatcaattgcatgcttcaaactcataatcttcagcaggaagtcttggctcggaaaaaggcgtattttcaaaaggtttctgaatctggttataatagggtgatggcatgtattcgagagcaggaatcactcatcaataaggtagtgagtgtgaacgtgtatgggaattttatttttgaggctttatcgaagattatgaacggtttcgttctcagaaaaatgtacttggatggctctcttcgtgtagatagctgtacatacgatgaacatctttatattaaaaataatctgatgccgaagaagctccctttggagcttttgccggatttaagtgagattatgtacacattgttaacgggtccgttatcggattttcataaatctgcctatccacttccggcgaatatctcaatggcgtatggttgcgaccacgcagaaatgttaccgcatatgaaggaagatttagcgaaatgcatagagggcactattcatcccagggtgtggatggtgtgcgaatataatgagttttttaacttttccggtgtaactgatgtaaatgacatgcagaaaaaaatgtggaatttcatcagagagttaacactttctgttgcactatataatgatgttttcggaaagcgattaaaaattgtacgtatagatgaggaggaggatttgaatggaaatgtcgttttgacatttaatcacgagtctcctctattatttcacaccggtggtggcatgacaaagtttaaagacgtgtattcgctgttatattgtgatttgcaagctcagttgtcgagggagactatagacgtgccggaaggagtaagttactctgttcgaacgcctaatctactagatctcgttagggagaatgagcaagatgacagtattattcctggctgtctttttgatgaatagtgttttaatgatatattgcgattcggataattatatcagagcgggctataatcacaaatatccttttcggatttgttcgattgccaaaggtacggatttgatgcggttcgacagagatatttcgtgctcgccatataagtctaatgcaaagatgtcggagggttttttcatcatttacaaaacaaatatcgagacctacacttttccagtgagaacgtataaaaacgagctgacgttccaaaccagttaccgtgatgtgggtgtggtttattttctggatcggacggtgatgggtttggctatgccgatgtacgaagcaaatttagttaattctcgtgcgcagtgttattcagccgtagcgataaaacgacccgatggtacggtgtttagtgcctatcatgaggataataataaaaacgaaactctagaattatttcctctgaatttcaagtctgttactaataaaagatttatcactacgaaagaaccctactttgcaaggggtcctttgtggctctattctacatcgacgtctctcaattgtattgtgacggaggctacggctaaggcgaaatatccgtttagttactttgctttgacgactggtgaaatcgtggaagggtctccgttcttcgacggttcaaacggtaaacattttgcagagccgttagaaaaattgacaatcttggaaaactatactatgatagaagatctaatgaatggtatgaatggggctactacgttagtaaggaagatcgcttttctcgagaaaggggatactctgttttcttgggaaatcaaggaagagaatgaatcggtgtgtatgctaaagcattggactacggtgactcacgggcttcgagcggagacggatgagacttatcactttatttctaaggagttgacagccgctttcgtcacccccaaggattctttaaatcttaccgaccccaaacaaacgtgtattaagaatgaatttgagaatataattaaagaagtctatatgtcagattataatgatacatacagcatgaacggtagttatcaaatttttaagactacgggagatctgattttgatttggcagcctcttgtgcaaaaatctcttatggttcttgagcagggttcagtaaacttacgtaggaggcgagatttggtggatgtcaagtctagacatgatattctttatgtgcaattacagtacctctatgatactttgaaagattatatcaacgatgccttggggaatttggcagaatcttggtgcctcgatcaaaaacgaacgataacgatgttgcacgaacttagtaagatcagtccatcgagtatcgtgtctgaggtttacggtcgtccgatatctgcacagttgcatggtgatgtgttagctatctcgaaatgcatagaagttaatcagtcatccgttcagcttcataagagtatgcgggtcgtcgatgcgaagggattaaggagtgaaacggtgtgttataatcggcccttggtgacgtttagctttgtgaactccacgcctgaggttgtccctggtcagctagggttagataatgagattctgttgggtgatcataggacagaggaatgtgagatacctagtacaaagatatttctatctggaaatcatgcacacgtgtataccgattatacgcatacgaattcgacgcccatagaagacattgaggtattggatgcttttattagactaaagattgaccctctcgaaaatgctgattttaaactacttgatttatattcgccggacgaattgagtagagcaaacgttttcgatttagagaatattcttcgtgaatataactcatataagagcgcactatatactatagaagctaaaattgctactaatacgccgtcgtatgtcaatgggattaattcttttttacaagggcttggggctataggcactggattgggctcggttataagtgttacggcaggagcacttggggatattgtgggtggagtggtgtcttttttaaaaaatccattcgggggtggtctcatgttgattttagcgatagtagttgttgttataataattgtggttttcgttagacaaaaacatgtgcttagtaagcctattgacatgatgtttccttatgccaccaatccggtgactactgtgtccagtgttacggggaccactgccgtcaagacgcctagtgttaaagatgctgacgggggcacatctgttgcggtttcggaaaaagaggagggtatggctgacgtcagtggacaaataagtggtgatgaatattcacaagaagatgctttaaaaatgctcaaggccataaagtctttagacgagtcctacagaagaaaaccttcgtcttctgagtctcatgcctcaaaacctagtttgatagacaggatcaggtatagaggttataagagtgtaaatgtagaagaagcgtgatggattcggtgtcattttttaatccatatttggaagcgaatcgcttaaagaaaaaaagcagatcgagttacattcgtatacttcctcgcggtataatgcatgatggtgctgcgggcttaataaaggatgtttgtgactctgaaccgcgtatgttttatcgagaccgacagtatttactgagcaaagaaatgacttggccgagtttggacagagttcggtccaaggattatgatcatacgaggatgaagttccacatctatgatgctgtagaaacgttaatgtttacggattcgatcgagaatcttccttttcagtatagacattttgtgattccttcggggacagtgattaggatgtttgggagatctgaggacggtgagaagatttgtgtgaacgtgtttggacaggagcaatatttttactgcgaatgtgtcgacggaaaaagcctgaaggctactataaacaatttgatgttaaccggcgaggttaagatgtcgtgttcttttgtcattgagccggctgataagttgtcattgtatgggtacaatgccaacactgttgttaatctgtttaaagtgagttttggaaatttttatgtatctcaacgtattgggaagattctgcagaatgagggattcgtagtttatgaaatcgatgtagatgttttgactcgtttcttcgtcgataatggttttttgagtttcggatggtataatgtaaaaaaatatattcctcaagatatgggaaaagggagtaatcttgaggtggaaattaactgtcatgtctcggatttagtttctttggaaaacgtcaattggcccttatatggatgctggtccttcgacatagagtgtttgggccaaaatgggaatttcccggatgccgaaaatttgggtgatatagttattcagatttctgtagttagtttcgatactgagggcgaccgtgatgagagacatctgtttactctgggaacctgtgaacaaattgacggcgtgcatatatatgaatttgcgtcagagtttgaattacttttgggatttttcatatttttaaggattgaatctccggagtttattaccggttataatattaacaattttgatttaaaatatttgtgtataaggatggataagatttaccactatgagattggttgtttttctaaactgaagaatggaaagattggaatctctgttccacatgaacagtacaagaaggggttccttcaggcgcaaaccaaggtgtttacttccggagtgttatatctggatatgtatccagtctattctagtaagataacggcgcagaattacaaactggatactattgctaagatctgtctccagcaagaaaaagagcagttatcgtacaaggaaataccaaagaaatttattagcggacccagtggcagggctgttgtcggtaaatattgtctgcaggactctgtcttagttgtgcgtctctttaaacagattaattatcattatgaggttgccgaggtcgccagattggcacacgtcacggctagatgtgtggtgttcgagggtcagcagaagaagatatttccctgcattcttacggaagcaaaacgtcgtaacatgattcttccgagtatggtgtcttcgcataatagacaagggataggttacaaaggggctaccgtcttggagcctaagacgggttattatgctgtgcccactgtggtgtttgattttcagagtttgtatccgagcattatgatggcgcataatctgtgttatagtaccttagttttggatgaacggcaaatagctggattatcagagagtgacatcttaaccgtgaagttgggggatgagacccatcggtttgtgaagccttgtgttcgcgagtctgtgcttggaagtctactaaaggactggctggccaagagacgagaagtgaaggcggagatgcaaaactgttcggatccaatgatgaaactccttctggataaaaagcagctcgctctcaaaacaacatgtaactcggtgtacggtgtcacgggagcggcgcacgggttattgccgtgtgttgcgattgctgcttctgtaacctgtcttggaagagagatgctttgttccacggtggattatgttaattccaagatgcagtccgagcaattcttttgcgaagaactgggtctaacggcatcagattttactggtgatttaaaagtggaggtaatctatggtgatacggatagcatctttatgtctgtcagaaatatggctaatgagtctctgcggaggattgcgccgatgatcgccaaacatatcacagatcgcttgttcaaatcgcctatcaagctcgagttcgagaagattttatgtccgctcattttgatttgtaaaaaaagatatattggtagacaggatgactcgcttttaatttttaagggggtagatctggtgagaaagacttcttgcgattttgtgaaaggtgtggtgaaagacatcgtggacttgttgttctttgatgaagaggttcagactgctgctgtggagttttctcacatgacgcaaacacagttgcgtgacgaaggagtgcctgtgggtattcataaaattttgcgtcgtctgtgcaaagcgcgggaggagctttttcaaaatcgggcagacgtgagacatttgatgttgtcttctgtgctttccaaggaggtggctgcatataagcagccgaatctggctcaccttagcgtcattagaaggttggcgcagagaaaggaagaaattccgaatgttggtgaccgaattatgtatgtgttaatagcaccatctactggtaataaacagacgcataactatgaattagcagaagatccaaactatgtgttagaacacaagattcctatacatgcggagaagtatttcgatcagattatcaaggctgtgactaatgcgatttcacccatttttccgaagaccgatataaaaaaagagaagttactattgtatttacttcctatgaaagtgtatttggatgaaacgttttctgctattgcagaggtaatgtgaacgtatttcggttttgtcgtttgtacatgttaacaataaagtggtttaatggaaacctattagatgtcctttgtatttttcgagtctatcgctgatttcgtttgggatgtccatttcttcgagctttttttgaagcatccctatgtcaatgtgaatattagtattagtatctagtgtttcgcagaggacagttaggattacactgtcttgtagtatatctagataaacgttgtagcccgaagataccgctattatttgtttaatgcattcacaaggaatgtgcagagtgcgagactggaaaactatgtgcattccgagcttttgttttttttcgaacatgatagggaatatgttgttgatcgtgttgtggacaatataaaagatttgaaagatagtgggttgtttggcggacatgcgtatcagctccatgtcctttcgaaagccgtagaagtaaaatctgttttgcatgacgttggtgacttggttcaagtgggcgaccattgcatctgaggaggttggaacggagacggattcgcagtgtaggcaggcgcttttggagatttgttcgttagcgtagggagagaattctaggcaggtgtgttgatggtgattgctgagactgaatgggacgtcgatgggttctttaccggtaattggcagttttatgatcgctagaaatttctgttcgtattctggaaacaggttgaagacggcgtgtagatcgtggagtttcagttgtaagtaaagctttgttttttctctgtgatcaggtcgtttttgtattctgtgtgtcacggacaggcttcgcgatcgtcgaaaacggtttttgtgtacagtcattctttaaacgtagtagttgacggtgaaaatgggatcgacgatatcgaagtggtgaagcgctaataagttagtgaagtctttgagaaactctgcaatttgagttttatttttatggtttggtttaataatctgaaaagctttgaaaagatgtatcgctagccaaacatgtttttcgacgatgcttaaatattcgttacggtagcatatggtgactttcaagtcttggatttctccggcgtctgtagtgttgaagagaacctccgggttaatggttttacagtttgccagacacagaggatcacagaagaagtgcttatagactcccactgttccagtctggcggagtatcaggtaaacgtgggtatcgagagtgaagttatcatcggagaatgagaattcgttatcgaatatcgccttgctgtagtcggaaagattcttgacgtgcatgtgtatttttgtcttctcgaagatatcggcaatgacgaactgaactctatctatcatctttaggttgttttgacagtagtccatgatgctttgatgtagatattttaaaaataggtaatcttgtttggaagctgccatcagttcacatagcagacagacgctggttgttttgtttttggtgatggaaaatggaatctgtgccaatagaatgggaccagctgtgagttcgatgtcggttttgttggaatacaggtttttgatgaagcgatgtttgcggatagttaggtccgtgaagggaactcggtcgaagacgtttgtgccagaccacatatagaataagagtgtcgtgaagcgagtcttcatgggcactgtgagttttttattcagttcggggttttgtgtttttttcgggttcatttttttggttagaaatttttttattttgatgtgcggtatactgtctcttttagtagggtcgatcgatatgcatgtgatcagggttatgttttcgctttggatgtgatcgttgaccgtatttgcgaagcatctgtgaataaaaaaatgaacgtggaagtcaaagatggagacaatgttgttctgaaaaaggccgtcaaaattgatgtttggaaatcgttctcgtattaacattataaattccgcggagacgatcagaagagacaatggagtctttggcgcgtagttgcatttgtagcacagtagactgtagtcgtagatccatgatttgttttgtttgaggcacagatttacgatggagcagatattgcatcgtctgtctatatttaatgcgacggataatcgctttaattcctctaggttttcagagctttctaaattggagatttcgttttctatgttcgtggggctggtggctgttgtcgtttcggaaggaattggtggttggggagtgaggtagcaatataacagaatctcgtttactatctcagattgtatagacaacgcttctgagtcccatcctttgtacatgatggactcctcacctgaaaagacgaatcttgaacttttgtatgagcaagtctgtgagcagggaagggagtttgaggtcgtgttttatccaatgctgccacgattatatgaaatgatgcttccttctttggaggcgcgactgaattttcttagtgttggatatagacacgttgctttttctagatacgttcacggggatgtcgattgcgtgcatcgagaggtcatggctcagaaaatcatacttctcacttcgatattgtcaaagctgttaaatgtaaatggaatattagaacatcaagaatatttaaatacggaatagcttttaaataggtgaaatggctaacgtactcaaagaaaagatgtacgatgaactactgagtgcgacctgtcgtatcttaaagttggggtctcatgactataggatgactgagcggaatttattgtcgaaaaatccgaaatttcctttgtgtgatattattctcaagttagactacgcttataatctagaatatctgttgagtctctgggaacatgtaactaagcaggaaccgagatttgtgttcaaaaacacaggcggacgtgtgtcgatgtcttgttatttgcatgccccggttaaagcagaaggccatcatgctgtgagagaatgcaacattctgcgtgttaatgaatgtttgactgttcgcatgagcgacatagtggctatgaagccttcaacttttgcagtgttcacgaaatgtataattaggcgtaatcgagacgaaacttacgttgtggagtttgtggcgtttgggcctgaaaacgaatctgaatacatttcgcttttgaaggcaattttcttaaagaagtgttctatggggaaacagcatctcgaatcgaataggttttgtcaaggtttgcgaagaaggtcttcacatgttttggaaaaggggcaactcggaagtagcggagaaattgcaaataaagcttctgcggttgtgacatcacaggagagtataaaccagttctatgaaaaagaaaagtcattcctgtccggtgtgaagttttcgagactaagtgaaaggcattgtcgggttgcgattgtcagcatctgctttcttttagccttgtatttttgttatgttctacttaaaaaaactcctacgccagcttctggcccggttgtgtaaacatgggccgtacactcatttgcaattgtttgtgatgggtgacgcctgtgtgccaggaaaatgtgttcttacaatgttcttgacaaataaaaaattcctgaataaggaagtaacggaaaaattttataatgagttttttgcaatttggctgcgttgcaggccggagacgcgatttatcactaagcgactttttaacaaaatggttatgacaaagggtctttttgttttgctcgcctatctgtatttcgtgtatcggcagtgcaaagttctcgaattgttgtctctttataaacttaaaagaatcaaatggatggacgtcgagactagatttagggtttatccctcgtacaagcttaataagttgctggagatgccctcgttttccgaaatcaatgagttgcacatgtttctgttcgagcaacagttgttgcttccgattccgacgcacgtcaacttaccgtgtatgaggctattctgtttacgtgactatgagcagaccgagacggtgatgttgcgatataggcagagagagcacgttttgtcatttccctccatgttgcaaaagtatgctttgaaatctccggcggggaatttcatgtttactatggcgaaggctttggtggaaaacttctgttttagcgcagacagatatcttattccagtggagcataataatctagtacctatggtgccgagcaaacctgaacggggtgattttccaaagattctaacctttgccctggcaacgtccttaaaggatggcttagctaccagtgttatttcgttacccgtcatgtgctattgtaagactaaatgttctcggtttatacttgaagagagttacatttgcgttatttgtgcaaaatgtggtcactgtttaaactccggaaaagaaaagttgtgttcgccgcagggcttttcgttgagctccatgttctattttagagacaagcaggagaaaaatttgatatacagcatgcatacggatgtaatgtattgttcgctgtgtgggagtcagcagttggtgttcgagcggatatatgaaatgtctgagcattgtgtattggggatgaaggtgaaaactgtttcatggaaggcggtgatcggaacaaattctgcttgcactattttaaatgacaatgtgaagttcgatgttattgttccttgttcgtgtagatcctgttattctactgtgcatctctacaacgtgaccgtcaagaagttgttacggcttgtttcacacggttctgattttcagtgtcagcattgtcagcattcgtttagagagacttgcttagatctggaagactgtgttaatatctgtcaaggttgtcagatttcccaaaacgtgaggtgtatttgaaatgacgaccatacgtggtgatgatttgtcgaatcagatcactcagatttcaggaagttcttcaaaaaaagaggaggaaaagaagaagcagcagatgcttaccggtgttttagggctgcagcctaccatggccaatcatcccgtccttggggtctttttgccaaaatacgctaagcagaacggcggtaacgtggataaaacggcgttccgactcgatttgataagaatgctggcgctgcatagactgaacacaaaaacagggagtgattgatgaaagcttcatttatttcgtatgtttaactaataaaaatttataaaaggagcatgactttgtgtgtcgaatgttacagatacaaagattttaattttgaaagagttgtatttatcgattcggagaactcgctgatttgttctcgagctagagtgacatcttttatcgctgcgctggccgtgttagcttttatgtctggactggtttccagtacgttggtatcagtggataggatgattgattggctcttgggcataagtccagtaacggtaggctgtttaaactttggttcggagaggtttttggtggttaaagtttcagagctaaggttgtatgggcgagtagacacagttttattgggcggaagttggtttaaaatatctgttgtttttgggtagagatgaaaggaaattaaatctgtcgcttcgtattcttgcacgggaaagtggaaaggattttttatgtagaaagcgactttttttggattggtggacatcggcggtagataaacgttgacaacttcgttgtcataattaaatagtatcaggggaatattgggtgtcgctctgtttgtgtggttgaggtaggagacgattttattgagctgtactgaaaagattgaatgttcgactatgttcttagtccatgactgtttcaggatgtagttgatgtcgaatgtgcgtgctctgaggacggattggaagtctttatcgtggagtacgttttccaggtgtctcatgcaaagcaggtatgttttttcgatggtgtcgatgtacatagcgaatgtcatttcgtaccccgtcaagaaagagtaaagaatgtagtcgaagacatattcctgagcctgcaggcgagtgagtgtcggtgtgttttgtgctttgtgtacggtgatttttgaggtaatcttttctccggattttattgtgtccggttcgtggggagttaccgaggacatggtgatcttattttggtgtacgtattcggagcataggtccttaattaagttttgataagatctttgggtaaaagtgatcggtttgtattgaatccaaatatagttcagaaatttataggggagaattaagaaggcagtgagatagataaaaaacttttcgttttgggggcacagttgtgtaaaaaatgtttgttggaaggtatctttcataagtttggcggattgccatagctgggtgtcgatacatatacttctcatcaaatgcatgggcttctcgggagggttgtggctaacgacgaatgtgtcatagagactgtctttgtctatgcttttggctaatgaatttataaccagatctgttggatgactgagacagccgtagagatattcaggatgtgagcatagtatcaaaagtgtgaattgcttgatgggcaattcgaacgctgtggaaacagtactgtcttcagatgctgtccaggcttgtgttatgatgtatataaataatttcaagttcacgttcggtataagttctcttttaaaattttgtgtaccgtctctgaggtcggagcctaggtccagagtgattatattctcccagaactgctgtagtataattatgaaagatttacacacggacaggagtttatattggctagataccaggcggggggtgtcttctggtacatgaatctgcttgtagttcagggagaaaaacttcactacggcgttgtaaaagatgttgtggaattgcagcggaactcctgtttcgtcaacaattagttgagttccaaagacagagtttacttggtagaacacttgacggtcccgttcaatcctgaggcgggcatataaatccgaaataggcttgacattcgctactgagtcatcgatcgggatgaaattttgttgctgaaataccgcccattgtttcagaagtgtgttctggatgtagttttgcgcacgcgttatgaagttgaggagtgcgcgcagaccgttaatataattttctgtgatgagtgagtcagaaaataggtcattttcctctggaaatttttcaaatggctggcttttgggcagcgacttgaacttctccattagtcgttccacattttgtcgttgcttaggaaagttgaatgctaacttgaagctggcgacattattgacggtctcgaagtattcttttttgagttgttctttttcgtaggtctgttgcatagaagtttcggaagtgagaatcttgttcatgagagtttgatactgtttctggccaccggcaacgcgtttaggatctaactccttcaagagcttagtcagtttcggaatgtttttcgtgttctcgacggtttcgttgcagatgactttgttttcaatttctacgtacttggtgttaatctggtactccaaatctcgtagggccgcgtaattgaacgggattgcttctttcccgaattcgcttatagctgacaggcagaatttgttgatgtcgtgtactaattgtgttaaccatttgagagttatctctgcttgaatgtaaggcatctcgttggctgctttgttcatcagctgacttataactttaaagggatcagaaataaagtcctgcagtttgatgtcaacgaagtctgggaagtagagcctggaatccgaaacaaaggctgtccattttgtatcgaatgaaagttttgttatatggttctgatccattttcgcctttaggtgtgcgttaaagtggtttaacagctcctggagttgattttctttgttgttgacttcgaccgtgagagctttagcagatgccgtttctctgaattgggtgttttttatttctttcagcgtgtgcgtatttaggactagataaattttattggtttttgcatcttgtgacgagagaagaatttttttctcagctactgcgtattctttggagagcggttcttttattttgttcgtctcttttttcagctctgtgatgcgttcttcgtagaggtttaattcttgtccgtagacggagtggctgattctagtatatttattagtggaggtagcaattttcgtgaggaacgtgatacttttttgcatttggtcgatctctgtttttacatcttctgtgcagaatgttgtttttttgaacttggataagaaactgagtaaaggggtatatttttgttcttccttggacatctgttcggggtttagaggagttttgattaatatcttttcgagaatgtcggagatggtcttgctgatggtcgtttctatgtcctttaacactggcagtagtgcatgagtgaagtgaatgatgagatcgttatcctgcagttgttttagaaaggtttctaaaagattcaaatgcactgtttccaaagacgagaattgaccgttttttagaatgagtaagatgtcgttcagtcttttttcgagggtgtttctgattgtaaggatgtgttttttgtcgttttcagcagtttgtttcatttgctcttccatatgtcgttgtagtgctttatcgagctcaggcttgcaagtttgtaaggcgtgtttagtgggtgcagtggctaagaaggctgtcagttcttcgggagatgtaatgacggctgtttttgctctctgtatccaatttttctcttcagcggtgattattttttgagagtagagaaatttgatatgatccatcagcgttggtattttttttccaaaatgctgtttcatcatgttttggagttgttcgctgttcgtcgtgatgaactgggccagatcgtcgaattcttctagagtttttaagttagcgcatttctttgctaattgccgtagtgtgagaacggattcgaacagtgctgttttttcggtgctgtttgggaagagatctacaagaaatagaacggttgaaaacgtctgctcagggactgttatgtcattgagcatgtcgtctatacatatgtcaagtatggattgtattttatcgtggagaatcgcagcgatatctggtcgtttttctaagatgaaatggaggtgtaaattttttacggtcgtagtattaggtaggttataagcagagagatggtgcaggaaatcgtaaataggggttaactcttggtccccaaggatttgttttgtgatttcagctgtttgcttgttttcggtggtggagatttccattttccccagttcttccagttgtgatttgatcatttctatatttacgattgtcttgtttttgctggggtccgctaagatggattcgattgcggctaggatttcggaagctctgtccgagggtttttgactgttatagaaatcgacgaacatttttctgatagatagggtaaagttcgaaaggttgtttatattgaagtgagaagttccgaagcgtagaaattgcgtgttgtcatacagtttttccacttcttgaagcaactcagtgttaatgtttaggccgctgtgttttaaaacttcaatgttaaaataaaggtttaccaggtaggcaaataggcaattcagttcggtaactggcatgaaaccggcagcgagattgttatagttatcttgtacgatttttgtgaatttgtttctgagtgtgtggatggtgttggtgagtttttcactgatttgtttttctagggataattgttgggtgttgttcagtgtggagatgtttggtaattcaatcgattcagtcatgaaacgcggaacgatggcttcagtgatgtcgctcgtgtgaactttgtgcacgttttctgattcgataggaagtgcgggagtttcgccgagtttgtcaataaaattagagatttgtgcgaaaatattcttgtctcgttcaatatcttcttgaatctcttttcgtttttcgttgagcagaacagctatgttgtgtttttctgccttattcagacaaacgaattcatggaagtgtttcacagggttctggctcacataggcttttagataattctctatgtcatctagtttctttggcatctcttggagcatttgtgtggtccacgatttgacccattcataatgtttttcgtgctcattatcagctattgccagaaatttgcttagtaagattctctcgagtgttcgaaaggtcgtggttttgcacaggtaattattgtaaatcaagaggatgtccagattgttttcttgacaagctgtcaacgcctcgttgaatacttcggaaaagtccttgaaaggcaataaataatttatgaaaatcgtttgctgcttttgtttgctagaatcgtcatttgtggatccgacgcctacaaacacgtcgacgatttgacacaataagtgaaaaactctgttccagagaaagggtgttgcgaagggctgattaggattcatgggagaatcttgtaagtatatggtccagttgaattgagatttcattataggaaaagatttgagatcgtgaaataaagattgaaattgtgatcgtagttcataaaagctcggaattaggtcgacttccgttgcgtaatatgtcaaggatgcggtatcttttttcttcttgtcatttagttctagttctagactatgagagtttttctttcttttctggggcgcgcgttctagatctgtcgttttagccgcaacgaggtcttgttgcgattcgatatcatctgttttttttatatcatggatttccgtggaagaaaatttatctagcgtaatcgctatgtcggggtctttataagtttttaggataagaagctcggcgtcgtgactagagagcgacaaattggaggtttctatgaaaaaaatgaagctggcgtcgtagtagaagccttcagtgccgtgggcggtgagcagttcataagcttcttcaatgtcttgacagatgtagatggctgctgtggcttctcgttcagtcgggtgagagtcgaataagtagagagtattgttaagaaaaaaaattgctcgcgatacgacgccgatcgtgatgactgcaaaagctggacaattcttggttttgccatacagtatgaaatctatgaggccaaaatatacctcattgtcaattttctgtgtgtctagggttccgttaaatggccgtgagagttcatgctgtgtgacgccgtacctagaatggatccttctggggatttcggtgaggagtctgtagtcttgcgaatctgagttatctagcattagagctaaggtgctggccgtgtctaagtgatagccttcttccattatggcgtctatagtacccgcattgagagaattgttaattccgtttaagtaaacagtgtggagaaatgaaaagctgttcgacatgcattgttttccggctctcggtccgtatttagagtcattttggttcgtgctactggtaatgattttcatgggttagaacgcgaccgttaaaacgtaagagaagcaataagatcttgctgcgctgcttcggcatatgcggcgtaccagtttaattgtcgttcgacgtgtctgactaggttgtacctatcgtcgaagatatcgagaaatggaatgcggtcggtggtcaatttttgggtagccatcaatttcttatatagactcgtggtgggtttcatgctttcaaatagttgtgttataaaaggcttgaaaacggcaactgcgtcctttttaatttcgagtattgtgaaagaattgtttgaaaccgcgagcgtggcggcctccagacatctagaagttaacgacgtgtttaggattgcatcggagctgagtacatcaactatggagatggtcttctttagggattcgattaggatgtcgtttgagattttacatttttcgaggttcacggaaattaactggtatgtttcgtttacgtgttgggagatgcgttggacagtgtcgatgaatttttgtagtgcttcgttggtcagcagctccttggaggaggagacgcttgttattatgtttagtagcatattcgtgagtgcggttttggaagtttcgatcgtttttagtgattttttgaattcttcgtgttgacgtactaaatttctgcatgtagcgatgaaggagtaaaacgaagtggtatcaattttttctgttccgatagtcatggagataaatagattgtctaagtttatgttgcatttggtcgctaagatgctggcgcattgtttcgtgaaggttatgtacgtctgtaacagggagaagtttgccgttatggtctgtttgatccaggggtttacgtattttttaaggtagtcggtatacgcctttagtagaatgcttacgagaaggtttgtctcaggggagtagatcgtatgcttcatcacgtttatgtggtcagcgattttcaagattacggactttattacggtgaaagtgcctagatctatgtggtctacgtttatggaaaaagcgtatagccacaccatgtagtgtagtagtagatgttgcgaggggagtaagagtttacaggcgtggatcagagttatgagtctgtaatcagattgtaatttatcaaaggtaagattggtaatgtatgtgaccataggtataacgtagattttaatgaataatgttttaaaagctggatgagtgctgtagggaagtaacgattcgtatgcctccggggaatcgctctgatagacctctttgcagatggcccttagctcaagggttgtaatatggtgtgccgtggagttttttgaggtggttaccgagtacgtgaaagggaaaaagacgtcaccccatttttcgaataggtttttgtatagaaactgtttatgttcttcgtttcctcctttggtatattctttaaaaaaggattcggagagagagatgttgaagagacagtcgatgtgatcagatatttgtttccagagtgtggaatattcatttcgttcgatgatcaaaatggctctctgttgttctaatatgagttttttcctattatagaataagaatgtcgggctgaaattttccatgcagatgaaaaacacgtgcgcggtgaaaacaatatggattaagttgatggtgaatgtattgattatgggttgggtgtctggtgtcgccatgtggtttgagaggatctcgacgtagattctgcacgtttctatgtttaaaccgattctgttgaagtgaaaaatcgtatctaagagtcgggataacgacgcgggtaagcatgagcttctcgtttcgataacctgctggatgacagtagcgaaaaattgattgattttattgagatcattctcccgttcttgagggattgttttttgatgaagtatgtgatagatgagacctcgatggaagagaatattttcggttccgaggaagtcgaggatggacaggtcggttttaagtagtggatagatatataatccattgtcctgggctgtgagattttttgaaaatattttcaagctaaacgttttttgataaagtagttctggactgtttcctgaagtgtcaaaaaatttatcgatgtctgtggatgtttgattgtccaacgtcttttcgaaaagatctattagatggcgatttgaagaagggtaatatgtaaaacagtagtccattttcaacagcctgtctagaaatgtgtcgcctggaaactgaatgtcctcgaaagtgagaatatgtagaaaccatgagtaaagtttccgatatagatcgtctatcagttctacgacggcgcggcagttggcaagaagtgaattttctcgtgtaaagctgtgtaccttttgtatgatggattgaatcttggagtattttatcgttttatcggtacctgggtcgttggcggcgggttgtactcgaagtttgccgattggagacgataactcattttttagcattttaatggaattgagtattcgatcgaacacgtaaaggacctctgcattatttaagttttcaagttctgtgcccggcgaactcgaagagcgaatttgactgagttcttcgtgtaaaagttctgcggagagcaatttattttctgatgttaaggtcgtagagtttaaaaagtagaaaactgtatattccctgataaggtcaaagtgatattttttcgggggcagtcgattaataaaagctattactctgttgtgtgttacgctatcggctgccagggataaaatctcgatttttgccgtagcggctagtaatgattctggggacgtgctgtttttgagtgaactaagaatgaactctaaatcgagtgcacgagctgccattgtggatactgtggaagctgtgaagaagagaaaatatatatctatcgaggcgggaaccttaaataatgttgtagaaaaagaaaggaaatttctgaaacagtttttgtccggcagggagaatttacgtatagcggcaagggttttcacgccttgcgaattattggctccggagctcgaaaatttgggaatgttgatgtatcgttttgagactgatgtggacaaccctaaaattctgtttgtgggtctgtttttcctttgttcgaacgctttcaatgtgtctgcttgcgtgagaaccgctttaactaccatgtatacaaactcaatggttgataacgtgttatcgatgatcaacacgtgtaagtacctggaagacaaagtgtctttgtttggtgtgacgagcttagtttcttgcggcagcagttgtctgttgtcatgcgtcatgcaaggaaatgtctatgacgctaacaaagaaaacattcacgggcttacggtattaaaagagattttcctagagccagactgggaaccgcggcagcattccacccagtacgtttacgtggttcatgtttacaaagaggttttatcaaagctccagtatgggatctacgtagttctgaccagttttcagaacgaggacctggtagttgatatcttgcgacagtatttcgaaaaggagcggtttctgtttttgaactatctcattaatagcaataccacgctgagttactttggaagcgttcagcgcattggtcgttgcgcaacggaggacattaaatcgggttttctgcagtatcgtggaattaccctgccggtgataaagctagagaacatattcgttgacctttctgagaaaaaagtgttcgtatagcttctgagccttctgtctgaagatgaagagaaaggagcgtcgtattaataaagattttggctacaacagaaaatgcgtttgtcattacgaagcgtcgcaaaaacgtttttgttattctcaatattcatgcgcttctgttttgtatgaacgggttcgtgacatcgctaagataatggatcggctcgactcaggtttagatgcttggtgtttgcgggatgccataatctctgttttgagagctacacattgcgttccacgagtggatcgaatgctaggaagatggtatctaaagacgagtattttttacgacttttgtccggacgatttaattttatcatgccctaatgtgattatgccaaatgtattgaactttgtaaagaagtatcgagattttattcgtagcgtcctctataaagtaagtgtgagttggaaaaaccaatatatgccgggagttttgggtgcatctcgctttttagaggagatttccaattctttaaacggtgtcgaagagagtattccatgcatctatcttcgtatgtgtgctactttgacagagatcgtgttaagaaatggttatctgcgggagatatatcaggagaatccttacgtgatattcgaagaattggcgttttccctttttactcaaaaatgggttttaccgttttcttgtatgacaaatttgggcctcgtggaaaaggctaatagtacggttttcgacgtggcgatttacaatacatgtttatattcgcttgcggattttataacagtaaacggcgagcatctttttccggctttgttaaacggttcaaatataagcatgaatgtgactcgttatcaacaggaagccaagaatatttttgagatattactgtctcaaattcaggtggtggaacgtgatactgataagacggttcagttgacagtctatgtggaagtctggcatgtgtccgcactaacgtggctggacttgtatcaagttctacctgagacttctcgggtcacattttgcttgatcattcctgggattttcatggataggtacgagctaaaaagagcgcagtggtctctttttcataaaaatatagcttttgaactgggaaagtgtgacgaagttactttctcgacaaaatatttggagtttgagcggacaacagatcatgcaaaaattactatggctagttttgtggaaaaaatttgccgttgtttaaaaaggggcagaatgggacttattttccgaaaaaacgtatatcagtattctatgattcctcatgtgcctttgtattgcgggggtgattttttggatgttttacctgtcagagacggtattaacacttgtttgagaatgttgcttaatgtggtgcatttcttgggtgacgaagtaagcgatgagctaaccgaggagattgattttgtgcgtttgcagtgtaaattttttatgtttaatgaattaaggcgggtggttcgaaaaatggtgttggtcgctaatgctgtaattgattatgctgtagagaataaagattttctgcgtgagggaattgtagatggacgaagtctaggtatctgtattacgggtcttcattccgttttcatgaccgtcgggttatcctatgcacatccagatgcttgtcgattatatcgaatgatgtgtgaacacatttattatacttgtgttcgaacgagtgtggattgttgcatgaaaggagcagagccatgcaatttatttgacaggtcaaaatacgcactggggatgttatactttgatcaattcgataatgtcgaatgcacgcttccggaggaattgtggacaacgctaaggaaagatgtgctgatgcacggagttcgcaatattcatttcactgccggtactgccatgcagaaagaattcgatatcatcaactcttctgaatcgttctggccgatggaagacaataaaattctcaggcggtcaaacatcaaagtcgtaattggaaaagacggtttaaatgatgtcacttcggtttattcgtcagaattaaaatcgttatatattcccgtgtataacaatctgttgctcaacagatttaataagcatcagcaatatttgaagactgtgggatatagggttttaaacgtggacacgaatctatttacggacaaggagttggatgatttagctgttttcaaagatggttttagttatcctttgaatgatttgattgagatgtataagagtgggttgccttttttggatcaggggcaggcaaatgtattttatttcaacgatactgtgagtttgaaacacttgctaccgttgctgtataaaactggattcaaagtcgctatgtataaggttttgtgtagttctgagatgtataaacaccttgatttatcaaatccgttaccgttgatcgggaaatgctcggatggtgtggttatgcacgtaaagaacattttataatgatgtaataaaatgttggcgccaaaaaaatacagtatataatgtgttggtcatttcatttgttttttaaagcacagaaggcgcgagttggtgctaggacttcgttcttgacagagatggagcgcggtagtcgagatcatcatcgtgatcaccgtgatcatcgggaacatagagaactgagagaaccgccgaccctagcttttcatatgaaaagctggaaaactattaataaaccgcttaaagcgtttacaaaactgttaaaagagaatactacagtgactttcactccgcagccttcgataataattcagtctgctaaaaatcatctcgtgcaaaagctgaccattcaggcggaatgtttgtttttatcagatacggagcactttttaacgaaaaccattaataatcatattccactctttgaaagttttatgaacatcatctcgaatcctgaggttacgaagatgtacattcagcatgatagtgatttgtatacgagggttttggtgacggcttccgatacatgtacacaggcgtcggttccctgtgtgcatggacaagaagtggtgcgagacagcgggaaatcgccgttgaggattgaccttgatcattcgaccgtttccgaggtgttaaaatggctttcgcccgtaactaaaactaaacgctctggtaaatctgacactttcatggcgcacattatagtacaggttaaccccccgactataaaattcgtgacagagatgaatgaactggagttttcaaacagcaataaggttatattttacgatgttaagaacatgcgatttaatttatctgccaaaaatttacagcaggctttaagtatgtgtgctgtaatcaagacgtcgtgtagtttacgtacggtagccgctaaagactgtaaattgatcttaacttccaaaagcacgttgttgacggtggaagcatttttaactcaggagcagcttaaagaggaatctcgctttgaacgaatgggtaaacaagatgacggaaaaggggataggaatcataagaacgaagacggaagtgcgttggcatcaaaacaggaaacgcaatataaaataaccaactacatggttcccactaaaaacgggactgcgggctctagcttatttaatgagaaagaagatagcgagagcgacgattccatgcattttgaatacagctccaatcctaagagacagagatgcgtcgtctgacagatagttttattctcggtcttgctaagggtgccgttattccagggctgtatccgtttagaatgacagaggggaggtcctccctcgaacagataggcgttgtgataaccgttgcgatttcctttttgttgacttttaaaaaatttgatccacgcttttataaacccataggtgatttcaagattgtgtttctgtctttaatggcggcgaaactgccatcattcttgtctgcagtggtcatgatctgcttgattttttccgagatgaggttgagaatgattttaagtcgttgtgtcctgattatgccgtcttattcccccgctgtgtttacggggatgatggtgtctttattttttaagagtcaaatgttcgatgattattctgtcttgacgacgactgcgtttctcctgccgtttactctgagatatggatggatgatacgatcatctggatttcttattagtttgcaaaaatatcgtccgattttgaagtcaacgtcgtttcgtgaagttgatttgaaataccttgtaaagtttacggtcgaatttttgttattatttacgatactctggatcggaaaaatcttcttgagtatgccaaaatctaatcatcttttttttctgacggtggtcaacaacgtgttttttaaactaaatgttttcaaagctgctgcgtgcgcaatggtggcgatcttgtcgggactgatgatgaacgtctgcctatatcgaattatctttgaagcctttttaggtctcgggtttagttcgattatgttgactttgagcagcgatctgaaagacagatctttttatgcgggtgatttattgaacggctttttttgtttagtcgtgtgttgcatgtattttggtgtgtgattagacaatttatcgtgcttgttttggtggacaccaataaaattttttgcagtattaatgtttttcaaatttgtgtttatttgctctgagccgggcagttcatcgttatgggtttgtcttcaagcaaagacatcgatttgttggtaaattttatcgaaaatcgccagggcgccactttagctttgccctggcccgaggattatcggttgactctacatagtgtagaaaacattccggatatttcacgtgaagatgttcaaaactgggcgaagacctatatgtgttgcgaaggcgaattggttgtggtcggggttatacataaggcaaaaaccagaacctgcaggggaccgattgtccttcagggggcgcggggacacatctatgtgtataatggtttttttgacagaagtctttatcacgtggcttcttcttttcacgatttgttttctaatggtttgcggtttttttatccgatttatgagacgtgtgattatgcactggacagtactgtggcactggatatgattgctcacagtaaatcgttttctgagctcttacattaccgaaatgaaagaaagaatgctttttttaccttgaaaacgtatccgtacaagacctttgttcgcttttgcaatctgagcatgactgggttttctagtaaacatttgattcagtggcggaggaaactgcagacgagtctactagatgtagtgtttattgtacagcataattttttcggtgactggagggagctcgtagtagtgtttgacggccacggtatgcttttttgcgtcgaccgcgaggagagccttctctttatagctcgcaatatgtcagattttttaaaaattggatgtctgcgttataatgagaatcgtcggttgcatacgcaatggtttacgcaagatacggactatattaagcaggtggatgagatgttttctagagacgtcctctgtcctctccgtgagcactgtcagaggtcgcgccgggatcgaggattattaaagatatgtacgtctctagtcaggggaattaattgtattgaaagagggtaggttgtattgttttaccatgttgcttataagcaaaactctattccccattcctagaagtgccgaggaactctgggaaggaacatacactctcgtagtcgcatttgtgctcgcatttctcgtctactccgattatcttagtaatttaagtccgtttggagaaattttgtcctcgccgtgtatttcaacgtgaatcttcgtcgggaagaggatggatcgccctcggacgccgccgccgtcctattcagaggtgctgatgatggacgtcatgtacggacaggtttctccgcacgctagcaatgatacatcgtttgttgaatgcttaccgcctccgcagtcatctcgctcagcgtggaatttgtggaacaagagacgaaagacgtttgcttttttagttttgacgggcttgcgtatcgcaatgattttgtttattgcttttgttatttacgttttcaatgtgaatcgtcgaaaaaaatgaattacctgtcttagaagcatttgctgacccgatgtggaacggaaacatgaacgttgaaaaatctctattgtttaaaaggaatagcaggcatcgactattaaactaacatgacaaatctgaatgtatgaggaagtctgaatttaatgcaaaatcgtgttttcttatgatcggcatttgtgtttttaatttgaattcgtcgagttgtattataaaaactaatgcggaacattgttctaaaagattgttttcattctgctatcttggtgtgggtgtgattaaaaaaccgttgcacttgggtaatcgcaaaaacatgttgttcttgtcttttttactcgtgtgtctctgtgaagaggtgcaaatgctcaacctaacgactacagaagtttcggcaactgaatttgcctcaattgcgtctaaaaatatggaaacgaatgtatcgacatccagcgactatttaactgggaaatctgaaactacgttttcggcgaatcccgaaacgtggggtaaaaatgttaccgaaatatcaatagcttctgtggcatatttaaaccagtcttctatggtgacctctacgctagccgtgggaaccacaaatcgatccagtggcaataatgtaaatgttacaacaagttcgtttccaacggtcaagggtgatgaggcgcaggatattgagacgtttttcacagtaatcttagcgtcgacactttccgatgtgtctgaaaagacgcctcagggtttgccgacgaaatccacaccaaaaaagacggttcatgctctttgggaaactgatactgttcaagtccctgagttaacagatacaaatgagggagatgaagagtattttaaagattttctaagctcgttagtaatttggatttgcgggattagttttgtcggggcattcataattgtgatagttattttgtataattggtataagaaagacaagcagaggtctttgctttgggatgaagagaataaaccggatgtgcaaatcaggagggatgcaaagacttgcagatgaggctcccatagattgttactagtgattatggtgcctcagggttggagtttagcatgggtgagtgtattatacgtgtcggtgatagcgtctttgcatattattaacaatgaaaattcagtttttatcggaacacatagtgaaacggagttaagacattggttgatttttgtaaaaatggctcagagaagtggaactgcttggtggcggatggctagtgtgcctattaatgcttatttcgaaagagatatagcctttttatttaaccctcgatgcgttatcgagactgccatggggtctaagatattatgtcgatacaataaaaatattggtgttgtgtttgtggacaatgatactacgtgtaatgtttcctttccgagcggtgtgcagttacaattactaaatcaatcggtgatggagtcaattagaactaaaacgtatgtagtggattacgctaggaaaactacagagagaggtgattgcttcatttctgtagcattctgccgaaaagaaagaagacgctttttaccccgctatgagcgctttgtttattactgcatctcggtttacctttttgctgttgtggttttttgttcttgctggtttgctttggatcctttgtttaatatgtgggcgtaacccctcgacgctgtggtatgacggcgatcttatattaaagattgcatcgctggagttagtgggcgctagtgatcgcaaaagagaaggaaaacgcagcatgatgatctgctttgttttcttatgcgtcttaacgttcgtccggggtgaaatctatccttccacttgtccggcccttggcgcagggaacggtgaagcggttagatctggggagatgctcttagagatatctgcatacagaaattggagaagcggtaaaatggagttatggggtagtgcggcggtaaacaaccaagtgttttacggaggaatggaagacagtcaaattgaatacgactttggaaagtttttggtttttcgatgtttccaggtttttcataacgtacataaactattgtttaataccgtgagtagtgcaaccatgcatcttgcaagaaagcgtgttcaaaaatgtggtcatggaaaaatgacatttattagcattcaagtccaatgctctgttaataaaaaatcgatacgactcagtagaatgaatgaaacaaatctcaagaaacaagtactacgtgttgcttttttcctcgatggtagcaataactcttggattgcagataagaatttccagggtgaagacagaacgatgttacgtctttggactgaactctcgacatatcgacagtacttgatatcttcgtgcaataacgacgttaaagtcctatctgagttgtacggcgaatttagacgaatggctctgtcttacgacgaggagttaaaactaaattttatgccggttattagatcttcttcagaaagattgttcagagctgatgatttgaaatgttcgttctctaggtggctgggcgcagaaggagaatttgcagtttgtgaatattcaggttggggtgttagcaagctgggaaagatcgagatctttgcggaggagccgctgacgtttgatatggtatggaaaacggtaaagatgagatcgtccggtgcatatacgtctttgtttcgcgatgatgtgacgtggggacttatttcattggataagtgggtaggggataaatatttctgcatgtgcacgaataaggagagtggcgataatgttatcgttacgcttccggagaagaatgtcgaaaagtctattcagatttataacgaaggttcgactatgttagcattcgcagagataacatctatcatggtgaaccttatgttcatgggtgcggtggcggtttgtgtgggtattctgggtatttcctgttttgtaggactgaaggagataatatactttatatttgttagtgttaattccatgtggcctttttgtaataagttattgactacggcggttaactgtttcttcaagggccgtacctttcttcgacgtgaattaaagatttaaaaatgataactgtttttgtcgcatgtttatttcaatgcgtttcttcgttgccggctaaactttacatcaagactactctggctgaaggaatcggtaaacttcagaccgttatcggcattgataacgatatcgtttttgcttacgagaggctttatggagatttgactttgcggaaccatacggctgttggagagacgttgtttgacctcgcgggaagcctggaagaaggaaaaaattctaccgtagaccgttttttaggacatgtggtaatacgtgaatttcatagattgcacgctgggcttcagtatgtctcagttcaaaatttttctgtaagcgaattggtttgcttcgtcaacaataatacgcagttgtctggcagctacgtttttttagcgagaaatacaacctatgtacagatagatctgtttaatgagaatcgtagttttgttcacgatcttataaatgtgagcagttttttacaaaatcgttctttgcacgtattgtcgttttatgcaagacgtttttgtgtagaagacatcttaaatttctatggtaaggttgttttcggagactctaaatatcgtcctccgcaagttttcagcaagagagatacaggtttgctcgtctgtacagctcgacgatatcggcccattggaacgaacattcaatggagtcttcacaatcaaacagtttcagatgatcatacgactgacgatttcattagaaccgaaatttccggtcaacttctatactcttatgaaagagcattgagtagagctttgagcatgacacatcatgagttttcatgtgaaattacgcataaattattagttaccccagctctcttaacaagagaggatgcttttagtttcaaaggttttgtgaatcccgtgaaggaatccgaggacacgtttcctcgtcataattttccagcgccgcacagaaaaaaatttaataaattgcagctgttgtggattttcattgtaattccaattgctgctgggtgtatgtttctatatattttaacgcggtatattcagttttttgtttctgggggatcttcatcgaatccaaatagggtgctaaaaaggcgtagagggaatgatgaagtgcctatggtgattatggaagtagaatactgcaactacgaagctgaaaatcacgacatggaacttcatagcgttcaaaacgtccgtgatgattcaatagcagttgtctgcggaaataattcgtttgatatagaacgacagtcaataaaatctcacgaaagttttagcaatgtcaagttagaaatgttgcctttgtaaaatgtttccatgactgtgaggtgatttgaacagagattttttaaataaattggttttttttgttaacagtgtctgttttttttcttaaggtgcttttagagattatgccacacccatttccggagttgcagtattttttcgtataaatttaactaagattgtgcagttcttacatatttggatggccgattatcttaatcattaacgagaaaaaacatcgtaatggcattcaccggtgatgaactggcgcgcatgttgcagtttaaggataagatgatttcttcggcggggtccgctctgagatttgagaaagttgtacaggaagctatggcttccggaattgttcttcaacatatcacttgtatcaaagttcggatctgtgacaattccgatattctatctgaccgtcagttgagatgtttattaataaacgggttgtatccttttgagggtaggatgagtatgtttggtgtaacggaggaatgggaaggtgcatctgcggctccggagagacaagttgtttttttgttatcgtcaactggtcaagtgcttggatatgaagatggtgtgatattttatttgtcacctacgttttcagatttctggacaactgccatggagttctcgtgtcagaacgcgatcttgagtaattttattgcacagaagtcccgcgatgaatacagtgatcaatttcaaaaatattttacgagaatgagacataccccaatttctttgacaggtgtattacctagacggtttcagaaggtagagagtggtgcttgcgtggaagaagatgctcgtgcttccatgagaccaattcagtctgactctttcggtgctaagggtccattttgttggccgacggaagaattgttgcagccatctgcgaaaaaagatgttggggggacggtgtgtatggctttatcgtgtcaagaagacaactccgctcgccattgcacaatctatggacttaccaaaactcctggtataaaaattatgttatcgaggcatacacagacagatcggtctgaggcgatgtgtgacgctgccactcaaactgaagacgtggtggataattcttcagaaactctgtttctcggtggaaatttggttcatcagtcaattttggaaacggaagtccaagcgaccgcaaaaaatacctttgatgtctctgatcctcgaatcgactcggtgtacgatacaacagtggtcggtgctatggcaaccgatgatgtaggttgtaaacatgttcagggtggtgcgtctttggcgcaagaaaaacctttaaaaggttattgtatcattgctactccatcggaatgcaaaccgaacattcattggcttaagagcccagaaaatgctgttcatgaatcggcagctgtgctgaggtaggttttttaattatttcacggatggggagagcgtgcgcgcaaagggtagttttagggatggtggatgtttttacttgatgcatgtggcaagtgctggtacaagagtgcacgaaagtgatgtggattatagatgactgaattgtgttgccgcgtcttaaatgggtttgttcttttataaagtttcaaatttgtttctattgtattccacagagatgcggcagattttttggaagaaattgcaaacgatctgtgaattctaaatatcatgaagaagttaactatggagtccttgttagtttatacctttgtaatgggagtctgctttacatcgaatctcacatgcgagcaaaaaatagttttaattcaggaacagaaacttggagctatatgcatctctacttgttatgtgaatggagtgttagctgggaattccagctgtgtttctgtcagaacttcatatctgatcaaccttgcgatgctaacagatggctttaaagccatgaaagttggaaatatcacatctatctctgaaaaaacggcttttctacgtgtgattattaattattattttagaggagtgatgctcagagctttgatcgctaaaaggcttccaaatgccgctcagctatcgagtactgtaaattgctggctagaaggtcatagcgcaggaggtgtgatgactctattttatggaacggaacggattgttctcaagtccagcactgaaatgaatgcgagtcaatggacaagtgacgggccagatgccaatggcactttgaacattttaaatgagagagtgtctctggatagctatttcctgagcatgatctgtcctcaattgtcggatgaaatttacaagaaaaaggttgtgcattcgaaatatttttcattaattaaaaatgatacgatgccgaaaaaattcttaagaaatacatggaagtctgcatggactaattggtataaatacaaggagattgaagcgttgttggatttttcaagggattacgagaatgtgtctgaaattacgcattcaatgtcggctgctgggttgttctttttggctgggggtgcatttacgatgctgttattgctatgctgtttatcaatgattacgcggaaacatgttgtgaaagatttaggatacaaataaatgtttattaaattacatgaaaacattcagaaaattggtgtgcactatcgtgagacattttctataaagtgccgtgagtgctatttgcattaaggaaaaggtgatcgtggacagtaaaacatgtagtggtcgtcggattaaatcatatctgcggaaataaaaaaatattaattacatatagtcaatggtgtgtttttctgtcggatttaaaatggattagtgaaaaaacttactcatctgcgtcaatgcgtatttgatagagaagcacggataacgttcattcccagtgtcgttagaatgtggagcagtgagacctataaaaaaatcgcaaacaggtgtaaatattctggggtattcgtaatgtgcagatcagtcaaaatctgagctctcctgggtattagtgtataacaaaacgataaaagtgtttaccgttttgttttgtcggtgggaattacggattcgactactgtagttttcgggtaagaagtctgcctgtggaaaggattgaacagtgcttaaataaatatcgcgtttctatcggtaaaaatttgtatccgcgttttttgatatttcttaccacttcaatgtcagtatcattcgatggctgccgcttatggatctgtttatcttgagagataatctctggattgtttcttccggtagaatagatgaagaaaatgttgatgttgaaggcgaacatagttgtaatggtggccgtgatttgctactctttttgctcttcagaaagtttggtgtctatgaggttgtgagggtttgtggctttcttatatataagattttagggaatttctcatatgacgagtatttgaattttccgcgactgtgattttttatcattcgtttcctttacgggaaatcagttgtatgagaagaaaccaaggtcattgttgaatcattattgtttacattgtattattttacatacacaaggatggatattattaacgtagggaattgtccggtagtctctgttgattttctatgggcgaacgaaatggtaattttagtccaacactatgacgttccttgtttttggatggtagttgattaagttgagttttttatctctgtgtgctataaaagatggataagaaatgcgagctggtttatttgtagttttgggtccaaaggggtagttgacggtttcataacgtagagatggcagacgaacgaatcggcgactatgttaaaactcgttatgacattgcactaatgaatttaaacgatataaaaattgcagtttttcgtgattctttatcgacatacgttgaacagaagaccggcttaactatacagtttaattggccgaaaagtcggtgcttggtgatttcgacactgtgtaaaattccatttcccacaaagtctgccgcagagttgcaagaaatgtgtaagtatcagtgtttcgtgtcagttttgtaatgtgtctttctcgttttttgttgtgaaaataaagttatttttccttttaaacaaggttcgttattgctttgctgcccagagagattgcaactacttggatatgtttctgcctggggaaaggagactcgtgatgtgtgcctaactaaaacgttggtgtttgtgggagaagacgaacgattctatggtctcgacttcgtgaatgagacactgtatttgttggcggaaacgacggaacgatttgcagttctcggattgcgtcgttatgatccggtatatcgagaaaaggacattcgctttttaacaaaaattgatgatgttcttcaatcgttgattgatgtgcaggataatttatggaaatttgctacgatcgtttataaaaatagtgggaggcattacattatgaagtcttgtttggaaaataacgacggagtttttgttttatttcttactaggaaagaagattttcctagtaggatggaatggaatttcttttcggatgtctacgagagcatgccgtatcacgggcatgttattgggagcattggaaaaacattactgtatccgaagacgatgtttgtgatgatggatttatcgggggcaatttatggtattgatacgatcggaacaggaattggatcatgtgttaaaatagcagacgaatttgaatcttttttaagacaggggattgttaggggatatcgtcgctataagtttttccatcagaacattagcaccgtccaagaaattctgccgttgtgtcctcatacttttctagggcccacattctcgaatgattacatttatgatttatcatctgaggatgaagagtagatagatacgtcatactttgagttgtatttaacttgatgtatggagatgttggatgttagtatacagaataaaaatttcagctgatgataagatttgtcgttgtttgttttttaatcctgtttttttaccattgtattggatatgtgttaagaatgagatgtcctaacggatgggcaagcagccaatgattcttaattcttaaagcgtgtgattcagtatctgtttttataatacggagagctgccgagctgagcggaacagagctttggctgtgacgaggatggatgtgtggaagcgtcaacggcttcaagaatgccgtgaactgtgtcctttgcctgtattaatgtcactgtcgaatatcttgtcaaataccgaaattatatacgttaaatatctatttaaaatggacttttctactatgtatagatttattttgccggctctgacgttgagtatgacggttactaaatccgtagttattgaaatgttatttattttaaaaagatgggaagagattaatcaattttttagattgaacatccggaaagtaaacgactgtttcgtcgtagctcagttcaccaatattcctgtaaaaaggtgggtattgatttaagtatacgtggaagcgggctttaatagttttctttcgatacaaagacaagggactttaattggattgtataaattgtttattttgttacaggaagagagaatgacaagctactgtatgccgattgatgtgtttttcttttacaggaagataattgtgttgttgtacatgttaaccagtagacaagagaaacagcttttccttaatatgatatatgcggtgagtttgattttgtacgtgttatggtagatttcaagatatattaaattggaattaggtatttgattcactagcttgctaggctatagtttttctggcagtaatttattgtttaatgcaaaactatcttagattggttgaataaaattgatggtgtgttttttttttagtttttagagaagagtcaccttagacttggtgatgatgaagaacagaatgctattcgttttttttcttacgttgatgagttacatctaacgcgggatgttctattggaaattatctacaagctcaagaatacggaaatcaatcaaacaatggaacttttattatcgtacaatgaattggccagataaagcacttttcacagtcaataaaattatttgtgattataaccttgcgtcgttcatcatttccgttaggcgcctggctacgcgtctggggcgggcattattttgtcttcgtgtctgagatgatgggaccattgtgggagcacgtcttctttgtccgttttgtagagctcggctttgacgagacatggagttgttagatgatgttgattgaggggagtgcggatggtcctccatgggttcttcgtcttctaattctagatctgccatgggatatgaataatcactaatatttgtttcgtcagagtaatgactacgattgctgtcttcctgtgagaaagaaaccgatgatgatctgctgttggaacgtattggtactctttgtcttagaatagaagttggagtggagcgatgcctttgcgggggggagtatgggacggtagaagtactgtggctgggggatgcacgagaagaggtccgtccttcattttgatttaactttctgataacttgctccaggcttaagccgtatttgcttgcaacggctccgtagacaactgctgagaggctctgcatctcaacctctaggacttgaatttcattgtcttccacatctatcgtcttatcataagaaattggcatgatcgctatagaagagaaagcattttccggggttacgttaaaaaagtcagaatctgtaagcacgttgtctactctgcctggatcgacttgtattgggggtttgtcttcatcgtattcgtcatcagaatctcgagatttcagaagcagatagttgaggtcttcgtcatcattgcttctttttaagacatcctcgaactctattaggtgaccctttatgaaggatggtaaaatgcaaatgtttgccttagttgcaaaaatacagatttcaaacaattttgctaatatgagtttgtagtgagggaaaagttctttatcggggctgacgagattcatatttgatatgagtgccgctaggtctagaattgtttccttcagatctggaagttggaatcctaccaatacagcagtttccattatggagttgatttcgtatttgatccaagtattcaaacgccttatctcttttttgcaattataaatcatattccaagtagaagttaaaaatagtaagtcgttgtaaatgtgagataaatatgcgtcatctgaagacgtaaacagtaaggtgggctttttattaactccaatagtgagatctttaagattatcggaataaatgtcgacagcttctttcagagtatacttgggtattttatagaggtaattgtatgctcgtaatttttctgcatactgttcgatatctgcgtccggtcgattatgaaaggagtttacggttgtttgtattaatctgacggcttttatgaatttagaatccggtaagccgttttcgtgcagggacaatgctatgagaggcatatatgaattatcacgagcatcgacaaacagccccataagagctctgtcgagttgtcgcatggcttcttcggtatcgaaaagacttttcatcattgtgatcatatgtttgacttgattttttccggcataaaatctgtttatatgtacgccgaggcgaaatactgacatgagcagatctcgtgaacgtgagaacttaaactttgtgataataatcagaatttgctctacggtttgagtcgccatgggaataaagctgtttgcaagacaaaccgcattgtaggagtctcggatgagtacctctttgataaatttagcgttggcgcgtgagagaacatcgggtatgaagttacaattttcgtctaagacgaaagtgggaatgttgaatgtcttcgacccttccatcgcgtgtgtgatcattggtgtgatttcaaccaccttaaatatttcatacgggatgtatcaacgcgagacatatgaaaaaaaaaactgtgacgtgagatcaggagaaaaaaattttataagaaaggtgatagggtgcaattattttccgaatcacataataagaaatctggatcgatagggtagacgatagctttttcgttgttgtctcctataccgtaaaattcaaacaggacagttttgtcaaaaatcacagacagggacgataattttttttttgaatccgcctgtgttttgcttgcgatataatcatgttctcttgaaatgatttcagcgtctgcaatcttacttgtcgggcgcatggtaaaagtgctggacaatatgggatcgtccgtcgaagttaaaagttttcgtcgtgcccgctttttagcgtgcgccatgctctatggaagacaaaacaaagaaaacagagctagcacgtgattttatgtgggtagcatttattaagttggaaaacgtgtttaagggggttcgttttcatccactgacgattctgatggcgagttctgatcatgttcggagacgtctgactgtttgcgattctgtgtactacatagtcttttgggaaaaaatggacattggaaacaggtggtaaatcggtttcttagttcgcctccagtgaatgcgtagactaacggattagagaaacaatgtacctgtggcattaatcgaatgattaactgcaatatctctgcacgggctaaccaaaagcaggtgttctgtggcatgtagagaaatgcgatttcagatataaggatagctatataggggatctgtatgagtaaaaatgacaggagaaggatactaataaaaaatagagtctttttgtgttttttcttggtgacgccgtgcaaagctttgcaaaagataaagtagaagaagctgaacaccatggttgggaggactccccaaatgaagctgaaaacaattttcaccgctagaaacagttcgtaagctttcggagaggatagataaacgacgcattttcccgtcgttttttttgctccgttaatctgcacaaagagagcggtgggaatcgcgcacattgaggaagctagtaggagaattcctatgtttcgccccgtgctatatgttttactttcggtctgcttacgccggtgcaaagttttgtacctaattgttgcgattatagctagcatgcttatgctatatgaacagactgcatgatagatgaagtaaactaactggcagaagaaacggttaaatgagaacagctgctctctgttcactgtcataaaaaagacacaccacatgagcacaaaatcgctagcaaagagtgtgatgacgtaaaatgaagtagcgttatgttttgcgactctgtgatagagaatcatggtggtaatcactataatgatcatgggtacggatgcagtgagcgtgattccggtaactgcgctctcaatgattcgtgctgtctttagcgtgggggtcgaggtacaggaagcgttgtctttgaactcttcatcgtgctattaaagatattgaatgttattgtcatggtacgctacaataaaatattcggtaacaatgatctctggagacttaccaggagtttggacagctcaatgacagtgtccatctcgtcgcttgtcagctttctgtgtgggtaaaaaaaggactattaaacattgagtcttggcgaagacgagcagttttgtttttgagtttgttttctaaaagatggatttgaaagcgcagtcgatcccgtttgcgtggctagatcgagacaaagttcagcgtcttacaaattttcttagcaatttggaaaatctggagaatgtagatttacgagaacatccctatgtgactaattcttgtgtcgtgagagagggagaagatgtagacgagttaaaaacactgtataacacatttattttatggcttatgtatcactacgtgttatctaaacggaagccggattataatgctatatggcaagacatcacgaaactccagaatgtcgtaaacgagtacttaaaatccaaaggtctgaataaaggaaattttgaaaatatgttcacgaacaaagaaaagtttgaatcgcaattcagtgatattcatcgcgctttactgcgtttaggaaattctattaggtggggtagcaatgttccgatcgatactccttatgtaaatcttactgcagaagacagcagcgagatagaaaataatttgcaagacgctgaaaaaaacatgctctggtacaccgtctataacataaatgacccctgggacgaaaacggttacttagtgacgagtattaataaattagtttatcttggtaagttatttgtaacgttaaaccagtcctggtcaaagctagaaaaggttgctatgtctcaaattgtaaccacgcaaaatcatctctcgggtcatttgaggaagaacgagaattttaatgctgtgtattctcagagggttttgcagacccctctaactggtcagagagtagagagttttttgaaaataatcaccagtgattatgagattatcaaaagtagtctggaatcatacagcgcgtcgaaagcattttcggtgcctgagaatgggcctcactctttaatggatttcgcctctttagacggccgcatgccttcagatttgagtttacctagtatatctatagatacaaagagaccatctgcggatttggctcgtctgaaaataagtcaacccaaaagtttggacgcgcccttaaaaacgcagaggcgacataaatttccagagtcggatagcgtcgataatgccgggggaaaaattttgataaagaaagaaacactcgggggtagagacgttagagcgacaacgcctgtttcgtctgtctctttaatgtccggagttgagccgttgtcgtctttgacttctaccaatctggatctgcgagataagtcgcacggtaattatagaattggcccttcggggattttagattttggtgttaaacttccagctgaggcgcaatctaatacgggagacgtggatttactacaggataaaacttcgatcagaagtcccagtagcggtattactgatgtggtaaatggtctcgctaatctcaatctgcgtcagaataaatcggatgtttcacggccgtggagtaaaaacacagcggcgaatgcagatgttttcgatccggtgcatcgtttggtttctgagcagacagggacacccttcgtgttgaataattccgatgtggctggatcagaggcgaaacttacgacgcacagtactgagaccggagtgtcgccccataacgtttctctcattaaagatttgagggacaaagacggttttaggaaacagaagaagttagatctgcttggaagctggactaaggaaaaaaatgataaggctatagtacactcacgcgaagtgaccggagactctggcgatgcgactgaaactgtgactgctcgggattccccagtgttgagaaaaactaagcacgcgaatgatatttttgccgggttaaataagaaatatgctcgtgacgtatcaagaggggggaaaggaaatagcagggacttgtattctggcggcaatgcagaaaaaaaggaaacctcaggaaagtttaatgtcgataaagaaatgacgcaaaacgagcaagagccattacctaatttaatggaagctgctagaaatgccggagaggaacagtatgttcaagcgggtcttgggcagcgagttaacaagattctagccgaatttacaaatctgattagtttaggcgagaagggcattcaagacattttgcacaatcagtctgggaccgagcttaagttgcctacagaaaacaagttgggacgcgaatcggaggaagctaacgtagaaagaattcttgaagttagtgatcctcaaaatctgtttaaaaattttaagttgcaaaacgatctcgattctgtgcagtccccgtttaggctgccaaatgctgatctgtctcgcgatttagattctgtgtcatttaaggatgcgctggacgtgaagctcccgggtaacggagaacgggaaatagatctcgctcttcaaaaagtgaaggcaggtgagagagaaacctcagatttcaaagtcggtcaggatgaaactcttattcccacgcaattaatgaaggttgagacacctgaagaaaaagacgatgtaattgaaaagatggttctgaggatacgtcaagacggggaaactgatgaagaaaccgtccctgggccgggagtcgctgagtccttgggtatagctgccaaagacaagtcagtgatcgcgtcgtgatgtaaaaaattttctctggggagcttcaggttgccaataaaatgtccattctcagacagctttgcgattacgtctttttgttcagtgttctggcttgtcattctttctacataaaacagggttgcgataggtgtgctttggggcaggatcagatttggagagaatgaacgcagcgtaatatgcaacggtgttccaggagcccacagcatcacctgggtttcgaagaaaccttcgttctgatagccggatatgaggatttgcttgtcacccctcgtgaaatatcggataggtagaattactatgtgacatcggcttggatagaaatggatgtcgtatggcgcgtgtacgagtagatcgtaataatttgggttgtgctgtagttgcatcgttgcgtttagtacgtctcctgtaaaatatagtttcgggttactggaaaataacaggggttcgggatcttcgatttgcgttactacttcaaactgaactattaaatatctcggtagattttcagtcgttagtagagaagggatttgctcgcagcatacggtggctagtgtcccaaagactttctctttatttttgacgagaccgagattttcaatattaattgcgaactcgtggcagtgtatcgtaaacctagtgttattaaagaaacgcagtgctactctgtcaggcagggaggtgtccggccaacttcctatgaacgaagcttttaggattctatgtggagctgtctgacctgtgccggtgacgctttttttccatgtaagatttttgatgactcccaggtagaggtagtttcgctgctttaaaatctgtatgtctccgcattcgtgttccggaaattgttcgtttagtatcatcagatctattgacgatatgaagcgagcatagtttagtgggtatctatacggaacgaacggcaccattaatacgttagccgacattccggttagcgaaaagtttgatctgtattcaacgggatacgaaaaacttcccgagatccaccctccctttgttatagttggattaaatacgatgtcttcgtcttctggagaggcaactaaaaagtaaagttctctgggagtaaagagtttagggagtgtgatgctagtccagctgtagatacgttgtcggacgtgtatctgacgaccaagtacctggtgtccgagatctagaattagggccgcgacttcaatcttccctttgtcgaaacgtattgatttatttggcgggacgaggcaatgctcatactgttttataaggcagtgtaggagaccgctgtagaagcgtaggggtttcctgatattttcttgatgccttttttgaattgaggctatagctcgtccgaatcccgatgaccaggtgacggtcggagatctcgctgaagccgtcttgtatgtgactatttccatctgtttttagtggcgcttcgagttcgttttttctgaagtggatctgccgatggctgttagaaagttatggaagacagtcgtacagctgttttctaaatcgaaatccgaggagtgcaatacagaagccggaacgatggaggtctcctgcttaaagtacggggtgcaaggtttgaatgcggattgcagctatgtcaaatcgcaatgcataaaactttcggaatgcgagtgtttatatacttttgcttctgatgtatgtaaggaagattttcataattccgaggaaatgaaggtgtttgttgtccaacattcgcaggaaatcgttggtggaacggatttttctgtacatgcggaggaaagcgtgtgagtcaaaacgggggttgaaatttaataaagtttgtcacaccactctcttttttccaatttcctgtcatgtgacggcgtctcgcatcgaggtcttatatttcagatatttcattgtttcacttctagtgttattcggagttttcaagatggacctcgaggcgaaggaggtctcaggtgagattccgaacgagaacgctcttgccgaattgtgtcgtttctgtgaatctgctgatctttctcgaatcgagaattttgtcggcacgtataagaactggtgtctgtctattatctggcctcggaactgctggctgagattcactctacgtaaagatgtagctggatatacagaaaagatgtttgaagatatgaatgatcactatcagggttttgtggaaaaactgtgtctactggggactattcagattccttacagagatgttccaattttgatcggccgatctaaaagaattttcttgcacgatctagagacggatactctccacttcgtgtgtgataattttgagcaatttgtaagatacggcgtcctgggtactaacatcatcacatgcgcggagcctgtgtaccgtcatggcttgtatgacggccccagattcgaatcgctggaaaatttaaggaataatgatgtgttaaggagtccctgtactttgaatgtccatctgaagttgaataggaaaggcgttttgggcatcaaggctatgaggaaacattacattgccatgttgcgagagtttgatgagctggcccgttgtgccagtttggacgatgtggaacgtttcgtgtctctcaacgtcggccgggatctgagattggatatgccggtttttaagagtttgactctagggactcgtgacagtgtctggatagggacatgtcgcttggcaaatctagaagaacaggaagacttagtagaaaaagtagtagtgttaggttacctgaatgaccatgattatgagtctaaatgtacaagacctattctatgtatagggaaatctggaaaaatatattattacgattggatagacaacgtgctggtgaagctgggcgattgtctactgacttttttgcgtgtgggatttgccagactttttgcggactgcggttatgagaagattggaaaaatatccatgcgcttcggacggatgtcgacgttgggcatgtcggagacttatcaatcgtgcatgagcctcagtaagtagttcatgtcgaattttcgtctgatacttgaaacggagggcggaaagcgagtcttgtgtgaaagtattgtacttcattttgcgtttatgtttcaaacagaaatcgtaccggtctgcaacgatgagttcaccttgtcatcatgtgtgcctactttggattttgatgtagacgtgctgtctgcagcttacggagacgggttggagatcagttctccgggcttgcgatgttgtatcgcctggcctcccatgtatgcattaactctgggtgagttttatcactttcacacgcatagatgggtaagtgcctatgactggagcagtcttctggatactgatgaatttttgtccgccattgggtacgctcacccgatatatcgtgatccgaatcctgactacgatccatacgtgatgcatagttcaactggaaagaccattgccgtggacacggtgacggagaaagtgtacatcatagcagaatcactggtccagttcttcaatatcggacttagacaatttccaccctttgccgaagcggagttagatccagagcaggaaaagatgtggttcggagagactaaatgcggccgagaggaatttatccttttacagaggaatctcccggctatgaaggattacgtagcaaaacattgtggcaagagaatcagggtggatgctttccaggactttgacttttccttttgttccttgtcggatatttattatctgactggacctggcattctagagaaaatcacagaaaaggattatgctatcatagggacgtgtgcccgctctcaagctgaaccaaattgcagagctgctatcgttatgggctcgaactgtcacatctatatctacgtagaaaacagaatcagcaaagtctctaaaagtttgaggacttttatacgtagaggatttgatgaattgctctataaagagaagtattcattggactggaatgacgataccttattttatataagtgacactgagacggagaatcttaataggatgttgaatggggagttgcccgttctccgcagtaagcctcggcatatgtgcgtgcgaaaggacaggtgggtagatgtgttgtgtgtcgtttttcccgaaaagacaattcttcgaggatgaagactctccgttaacttgttttttcttacaacaggctcgtgaaagaccgcagcaaaattctgtttgcggtgcgtctggacgaagaggattcgccgacggttaaatttatcacaaaatttctcacgccggtattcgtcggtcgactgcccgctaccagcaggtttgtcgttcccgtctcctgcgctaggttgacgaacggtctgcagggaacctcagcagctagatttggcattaaaggactacatccctcttcggactgcgtagtgtggaacagactgatagattatgagtatgaaacttacaagtatccttccacctacgtcagagccgatcagattgctgacatggtgaaaaacttgaaatttatggacaattttgatgagaagtggcagtgcatcactaaactggcttttatcggtctctatgctggagcgtctctgtttaacttcgcgtccaaacctacgctgggctactggtgtcgctatctatgtgagtacgcctccatgttattatttcagtttgaaagcaagttaaaagagttgacaaaggaatctactcggcagctgggaggttataatctttgtcactggggtcaagaattgaaggactgcttggagaacaaatccgatgtcttcttcagatacgatttctttgagcgtatcgaatcctgtctcatcgagcactttatgctcctgtgtggttgtgtcgagtgtaggcgcatgtttatcatgtataacaagagaggcaggaagtgtgattttggccactgtgtccgaattcagtgttttcctatgataggttcaattcgtcttccggcttttctgcatttgggtgaaccctacagtgtgagtctgtcgagtctcatagcgaaggatttagggttgagcatgattgaaggtcagatagagcacagtaggctgcctatttcgctacagatctctgtcaccccggataagaaggcattgctaaccttcttaactaacattgttttcattgtgttcgtcgtgaacaccctctaccgtgtcataaatgctgagttggacatatattacgacctcttcacggaagaagtgggaaaattgtgtgtgaccatggaggaagaaatgaagctggggcggaacgggtgcctcggagacctgtgctacttttcttcgatgaaacaaatgaaagaaattgttaggtgtcccggggaaaagagtcagtttatcttaaagtgttgggaagctctgagaatcggtttttccgttcctgcttacaaagactacgacgagactcggttcatggaaatgttttttctgcatcatcttcatataaaacgcttccacgagcacaatgatcgtgacctggtgtcttctgataatctcattccgggtttttttatcgttaatacccatgaagagaatttcttacagcggctacaacgggtagtgttgcccgtcgccgaagattatttaactaacaccaggtgcataaacgggactatggctttttttttcagtggcttgaaatattttgggagtggtaatcatcggggtgttcaaataagtcccgagaaagacgtcagagctatcgggtataaattggggtcgttggacgtcctcagggatgattacaagtattatgaatatgcaccggactgtgccggcgaactgaatggacatgatggggatgagtgattgtgtgttttctcgattgtgatgtacgtggccgtctcctgcaatttgaattctgctcgtttgtttttttctgcgacaaaaaaataaacgctgtctcagatatatacttacttgagtgatggagttattggaccacgacatttataagggacccgttcgagaacgggtcacgtataccattcccaaccatccctatctctcgctgaccgttcaccattccagggaacttgatgttgatctgaaagacataacggaggagatgattatagatagcggcacgttgaccgcagaggatctgttcatgacccgcggcttacgattttgtgacgatagtgttctctgggcggctctggcggagaaagtttctgtggaattccaaaggcgtggaaagacgaccatggatctctcggctttcatgtctctcttagaacggttaacttttgaggacgaaacgtcagctttttatcgactcctgaccaagtgcaccgctctggcgcacttctcgattctggagtacatcgtcgatggggagaagagggatactatctcggcgcatttcaaccgtcttttggagttgttggactccctcttcctgcagttccttatgctgaggaacaggagtgagtccaatactctgttgaccttgttcgatattttgcccaatcccaaggagatctatggcgacgcggcgtctccgacgagtgtgctcttgaaacactttttgtccgattacatctttgtcgcgtacgcttcttcttatcgctttgtgtcttctgtgctctgtagttgcgatcagtgccgggcgtctctctttcggatctatctgggtaagaaagattcccgggccgtgaacatatctgatatttccgaattcgatccagctgatctaattttaggccagctgcacctcgacgcgcgtgaagcggtcgctctccgggcggagattgaccgagatcttggttcttctcttattcttaactctatggaaaggcggcatttgcccattcttcacgataagcagttggggagagggcatttcgaacgtaacatcttgaaggtgtactgcaacatcgttctgtgtctgtttctgctgagacgcgtcaaacagcgcatcgtaagtgatctcacggccattgctcgtttcttcgtaaaagcgatctcagaaatggagcgttgcatcgataccgtttctggcctccacggtgtcaggatcaaactgttagttgtcagttctcagttcgagattaaagatcccatgcgcgtccctcggttgtgttttttctttcttgagatcgtgacgattctcgtatcgggttatgacaaggaacggcatcgcgttcgtgcgctcttggagcatctgtgcctaaaaaagatctgtctaggcgacctgtgtgcatccatgcgactcgctcgcgagataaggcacgatgttctggagggcttcctcaatactctggagttatcttacatgtcgaatccggtgaggttttttcgttttcacgactgcaatctttacgggacccatatgtggagtggggtgtatccgaacgtcgttccttacgctgtggccggcggcggctcgtttgacatcaggttgcaggagcaccggagacgtcaaaagcgaatagtcctcagacgtaggcttataagacgcgtgcaacagcgagggttagacattcgcgaagcgcgccgcgttcctaagctggcttgtgtgacctttatctgatacagacgaatccggaaaaccggtacgcttctttcactttgtttagctttaaaaaaaaacgatattattgttgccgttgtcgtgtgatcatccatatcgttctttttgggtgtacattgtgacaagtttcttttgtgactatattatctttcatttttttttgcgagttgcaacttttgcttactaagttttgagtgctatttctctgtcgctgtgagcccgtaatggaaacgacaaacagccggcgtgtttcttcggcgcaacggcagattttggctacggctacggtgcgatttatcgaaggccttcatgagccggctcaagattctatgatgtgtggggatgacgagctgcagtctcaggagaggatgaagaaacgtccacgtctctataacaagtccaagagagatctcgtcgatctcttgcgcgtctatacgtgcctgaatagcgtccgaatgtttacgttcgtcaatttcggcaggcgaattcccttggcttggcctgaaggatacgagctggttattaacaactgtagagacgagaatgaatatgccgatgaaaagttgggcggactggccgatctagtgtgtttccgggagcgcctcgtcgtactggggcacgtgaagaaaaggggggagatcggatcggagccggcttactggtttctgaaaggtgacatagtcgttctgctcggcggtgccggtcgcgtttatgcgcatacgtggttattgccgcagcaactgtgccgcgtcggtgacaccattgacgattttcttcgtaaaggtctgaagaggttctattacgcacatcagctggtatcatcgctgcagtttgtggtggaggacaccgaggtggacggcgtctgcagttgtcgggacgtgctgtgctttcgagaccggcacataggtcgttctttcgccctgaggtggcccaagaacgagactctgctctttcatcggcggcgggattcttttgtattcgtcaggtgcgacgaggcacggcgcaggctcgcggaaatgtgtttcttcggcagcttcggctacaagtactttgcggacgccggtcggatttctctctacgtggccgacgacggacggattttcggattcaacgacaacgacgaagacggacggccgcgctttgtggcggaaaattttcagcagtttagacggataggagtcattcagtattataagagctacgttttccgtagggagcagcccgaatgggcgcttcttccgacttgtcatctctcgcgaatgttttatcagaaaacttggaggcaggccgacgatgatctgctgtttgtaaaggctagaaacgatgagcgtcaggaatttccggacgccggcactaggagtgccgtgcacgacgtagttcgatagttcgccctaacgttgaaggttaggtttttttttttaaaaaaaaagaatggaagcgtggtagatcgagttcttacgggcgcttttgacgtctgggatcattgtatattttacccggggatgggatgtgttcacagttttgtgggcggtcggttcacttccattttcgtggaagacgtcgggaatatgtcgattcaacgttgtttgtttctaacagttgtagcgtccttaacgtgatcgtagacgtttatgtgagactgccggtaacgctgccgttatcgtttttttttttttttatccttttaattttatctcggattccgcacagaaaaaaaatgttttgtcgctctccgtttctcggcatatcttcttggagtctggcctctgctgctctctgcccttcttcgtgctctttctctgcgggacgtgacctgcggtgcgatgcggcagtaccggaggttaaatggacggcgttcgttcggactctcgtcgcccggccgctatcggcggacgacgtgagggacttcgtctctacttttgcccattgcaggttggcgctctcgtggcccgtgggggcagaactgagattcgccacttccgacatgctcgggatcacgcaggccgagttggccaagctgtctcgcggatacgggtgctgtcccggtatggatctcacggtcatcggggtcactatcttcgcagaagtttccgcgctggtgctggtcggagagtgcggggagatatacgcgtttaacggcgtgttcgatgacgcgctgtaccgtctcgcggaggacgcgttcggtctctggaagcacggcttgcgtcgcttcgagcccgtctacggttccaagtgtctcatggaaaccggcgcctctttcttcggcggcatgagtggagttgacgacgccctggctttcgccgtgtctttcgataaggctctcgtgccgttgccttggccgcgcggagctttctttgagtttgccgtacccaggagggcggagaagaggtggcggctcatacccggcggaggcgtcgcggtggtgatcggcagattcttcggacgcggcgttactttacctctgctcagacgacagcgggtgctcatggatcaggtcggcagggtgtatgcggccagtctcgacgggggagccgtggtgcgcctgtccgatagcttcagggcgtttctcgccatgggtgtcagaaaactcttcaagaaccatcgattccctccgggacatctgtggaccatgcagctgcccgtgacgtgcgtgcacgcgcctgtgataaatctacctgccgtctatcaactttctccgcacatggtagagcgggaaatgtccgcagtctcttgcggggcttctaccgtagtccgtagggactgcgaggacacgttgcgcgacggagatgcgggagttgacacctcgtgatcctgccctcgtctgttgctgtagttgatgctgttgctgctgttgttgttgtggtcgttttcgtggttgtctttgtcctatgttaacattgtgagaacagcgcataaataaaatggtttttttttgtgtgtatttttttatgtgtgtgtatttttttgtgtgtgtgtatttttttgtgtgtgtatttttttgtgtgtgtgtatttttttgtgtgtgtgtatttttttgtgtgtgtatttttttgtgtgtgtgtatttttttgtgtgtgtgtatttttttgtgtgtgtatttttttgtgtgtgtgtatttttttttgtgtgtgtatttttttgtgtgtgtatttttgtgtgtgtgtattttcttgtgtgtattttcttgtgtgtattttttcgtgtgtgtgtatgctttcgctcacgtggcagtctgctcggtgaggccgcgtaggcatgtctgtgcgtgttcgcgtgcgtatctgcatcaccgaaatgggtcgggggtctgtggaaaggtcaatcgcccggcggggcgctctgcgcatccgcccgttggccgtttctacacgcgtccgctcttctccctctctcgcgccacatgcgggccctcctcgggaacgagcgcaccgcggccgcggtggcgtagtctgacgctaggtggagctcatggccctcgcggccgttctctctttcctccggcgtctcctcgtctgtccctctgcggctctgccttctgcctctctttctctctcgcgcgcgccatcgttttttcgctctcaccgggctccggcgcccggctgcaccttcgcctttaaactacacgccatccacccccataccctcgcccgttctttgggggggggaggtggggggatcccgggcgcggggcgcaccggcgacacgcgcggacgactcgggcccgtccgggaggggaggttttttcacgcgcctctcgcagtggcgcgcgttttggtgaaaaacacggcgcctcccatagaggcgcgcgcgcgcgcgttgggggatgggttagggttagggttagggttagggttagggttagggttagggttagggttagggttagggttagggttagggttagggttagggttagggttagggttagggttagggttagggttagggttagggttagggttagggttagggttagggttatagattgcgccagaggcttcccttggcgtcgtgccagaatagcaagggtccgagacgacggcacgtcgcgcgctatgccgttcctcattgactttacatctgccccccgtatgctccccgcctgcccgcccgcgactgccatagaggtggtgtgtgcgtgtctgcgtgtctgcgtgtgcacgcgcctgtgggagaaacgcggacagaagtgattacggaggggggggggtattgtggtagacggggtagggagggggtgaagggatgtttcctttgttagtattttgcagcgttgcttatttttttttcctagttgccatgctaggagtcggcctttgtcgtcggtccgcgtgactgtctgtcgcatgcacttccgtatacttttttttgcgccccggcacgtcccgttgattggattgccgccgcacgtgtattcaatgtcatggtctcctctttttttttttttcactgtctatctttgaacctgttatcgtcttcccgccaaggctatgtgtctccgccttttttattttttttacgccgttgattttccgcgttcgtctccaaccccagaccgacctcgtgtgtatgttggctcctcccactccccggggcgtctatataaaaggcgaatgtggcgcgctttcaagcagtcccgatctatgcgactcaccgtgtcgcgttggcatcgggcgctgctatagcaactccgctagagggcggcggtgtctcacggacaggaagtatgttttttttttgttatgtggtgtcagtaacacggaacgtaagcacattgtgtgtgattgtgtacattcgccgattttatttctcatcgggttaaaggcagggagggatacggtcacgcgcacatatacacaccccacacatacacgcaggcggatagacatctccaccgcggttctgctttttcttttcttgcgtttgcgcactcctcacttttttttttttgttttatatttcgagatccttgtcatgatcttcctccggtcatgtctctggccgtatatcgcatccttacgtctccgccgtggcgtctaatccaggtacgctctttgccggggaagttttccgaccggcggtctcacgtgttcacaggagtggccaagcgttcccggggagatgtctacccggggccgaatacgtccaatgtcctctcatggcccgcggcccatcctccacagggcggcgaacgagttcgccagacggcagatcttgccgttatcgggccagaacgataacagcggtcccgccaggtgacgatcacccaagccgtctccacttcgcgtggccccggcgtgggcacgtttcccagagtcacgcctccgctgcctatcggaggcgacggcgtctgcgtctccctctctcgagacagaacggcgcacactatccacggtcccagggggtgtcccgcgtacaggtgcaggcggagctgtctccgggcatcgggccacaagcgatactgagcccgcgccacggtcagagtcatgcgtacgcccggaaccgccgtccacggatctcgcacggtctctagtaattcacagctcactccggcgtgcgtttgacacaggccgccgacggtcagcaggtcgtgttcgtcggcggccgcggcgatcacgtcgaacagatgtctgacgttcgttccgcacatacgccggtccggcagctctaggtcctcctcatacgccacggggtcccgctgcagccctcgccttgcaaactccgttacgttcgacgccagtcggcagagtctggccgccctcatgtggtggacgtacacggctccgtctctaccgaccaggagcacgcgaagcgtgtcgagcggggagtgggtcagatacgagcttacgaagcccacgggttgaagtttttctccgtatccgcaacatacgtacagactcgagtccagggctggggcgggacacgcgtacgagaaggatcgaggatgaccgttccggccgataccgtagaagaatcataaaacatgaaaacgcaaaacacagagaaaaatgcacgttatagtgggcgttccgctattttcgtctcttgtctctgttcctataaaacagcagaaaacatccgcacacgcaaaggcatcccatcggccggacgtcacgactggcgtcccgggaactcgcgtttctgcgcgaacgggagatgccgcatagagtcatcgtagggatgcctttgcggcgtgtaacgcattcgtatcctgtcgcgtaccgttaacgcgaaaagcatacgcaacagcaatggcgactactaactcaacgcgataacacagaggaaaggaggagctttactgtttcctcttttttttttatttttttaaccgttgtgtgtacgtcgccgacgtacgttttatacggaacctaaaaaaaagcggtctcctgtacactatgcaggatatccgtaatcatcgtgttccggaagtcataccgcctgtaccgtccttaacggaaagtacctttgcggggaatttacgtataccgcattaccgatgaatacaaaaaaaaaaaacaatgtctggaggaaactccgtgagtcgtctgtgaggccggaggccgtggcaggcgttgccggctgacggtcacgcgtgtcacagacttcaccatgtttccttccccccccccccccccgtgtatccgtactcgttttccgtaactcgcgctttgacggtctgcgcaccctatatttctccgcccctgacgtgacgttgttttgtccccactctccgccagccaatgtcttcggtggttttcgacgaaccctccacccactcaccctccacccgctcgccctccacccgctcgccctccacccgctcgccctccacccgctcgccctccacccgctcgccctccacccgctcgccctgcggccgacgtccctccccgccgctcgcccgtgtgcgcatagcgtcgtcggtcgcggcggcgctcactcaccgcagtcttgaacggatctgggtctcacgtgcgttggcggccaaccccagcggtgaccccacacggtggcgctcctggcgtccctgtacggatccggatggagttctaggcaccagtaccgcggccacggtaggtggatccgttctccccggtgccgactcgtatagccgtacagtttggacggcctgccgcgagccaggagcagccactcgaagcgggcacgggctcgcgcgtgggccaatcgcgccccgtcgcgccggatcgcgatgcgtccgtccctcatctgcgtgtgtcgcgttgtcataacccccgattcgtgtgtgaatcacggacgggtttttattttcgtccgcccttggcttcctatgtggaccggggcctctctcttactgtatttatcttatttttgctgtccgctgtagctcttgttgtgaccaacgaccgttgtcatccgcggtcgagtatagtcagtgtcgatacggcaaggtgtttgatggtctgtgatggggaggggtggagagataaaaaaacatgtatacggtgtagtcagtaacactcttggtggtggagcggctcagtgaaaaataaaagaaagagaacgctgtgagcggagatgaaccatagaatcgcggaactaccgcgcggttgaacggtgacgacggaccgcggtgttctgtgcggaaccgacaccgcaacgccctggcagaaccgcgtctgcggaccccgatgtaaacgggcgaatccgccgcgtgccgcatctccgggaatcaccggggacgtcacgtggaaacatttttaacaacaaaattcgttttatttatgtgtctttcgtttttcccaccgggtgtgtcgggggatgagggcggggggaagggcatgaggacgagggcgggcccgggcaaatagtctcgcgataattcgggaccccgcgtttacttctcgctctttatgcccgcatgcgtcggggtctcgtttcgccttcgttgccgcggcagggtcggcgccagcccatcgcgaactcgggggacgggggtgtggcgccgactctgccgcgttgcggtttcggggcgaggggatgcgtcctataggcgcgcacgcggaaggccgggcgtataggaagggtggcgcgtcgcgaagtcccgcctcataggtggggcattcgaggccgccctctatactttcggtttcaggtacagttttgtgattaggtctcgggctacctgtggattgggagggccggagtctcccggcgtgtctccgtttatggagaggtcgggtccgccatttattgaaaggggacgtacggagaaggatgcacgtttagtcagtgtttagcctttattttcattttttttttatttttaatttccacatagtattttttttttatttacaacaaaatttaacttgttttattcggtactctttcactatggcgatgatctgagagcatcggtagtccccgtcgtcgcctccccgggtgctccgccacgactaccgtgacggcgacagccgccgccgccgttactgtcactgttcaaagaacgtggccgttacagtttccgctgccgctgtggtcgccgcctctgcggagagagtcggcgtgtatgctccggggagggggatggagggaggggggggggggaccgagggggcgtgggaggagcgttgccgtggaggcgttcgggggactgcccgccgacgcgcctgcgcgattcgagtgggggtgagagggacggtgaacgggccggcgagcgtttgcttgtggtggtgtgtttttttttgtcatcggttgcatctgtgtgaactggcacgagtcagatgatttttttttatcggggcggatcgggcggggggcgcggagcggatccggccctcaggtgactccgcagactggcgtgtggaccgtacccagggaggaaggatagcaggagtcggtcgatcgtctcgctccgcttggttttccgtgtcacggcgcgcgcatagactccgttaatttcggcggccgatgtctcgcgtgttctcgtgcgtgctccgcgcgtgtgtgtgcgccggcctctgctgctgggtgtgtatgggggtgatatgcggtgactgtcagcggtggtggcggaggaggtgcgcgaggtgggggcgtgtcggacctcgggtcctggacggaggggcgtggagggtccggagcggcgacggagtccgctcggtatcgcggacgtgcaaaaccgagcgggctccatccgccgctcggtctccggtgtattcccctcctttcgtcctcgtttcttcgtcttcttcgtcttcatgttcttctgcatgttcttctcgtgtcccttcgccgcctccgtcacctcacgcggcgtctcacgccgtctgtgcggagggcggccgcgacctgccgatgcacggcgcggacggagatgccgatgagggaacggacgggactcttttggaaaagggcggcgcggacgagggcgccggcgggaacgccacgggatgcccggaggacacccgcggctttgctcggagtcccggagatctaatgggggagatgaacggagatctgggagacgagggagagacgggagagggcggagacaacggggagggagagtaggacggggaggaggaggaagaggaggaggaggaggaggaggagagggaggagagggagaaacggacacgcgcggtggacggcgaggggacggacagagcggagaggcgcgggacagcggactgcggggcgtcgggcgacgggcagggcgggcacggagaacacttagagggttcctccgcgggacctggcgggcaccgagggcgggcggacggctcgtcttcgacgggcgttatcgacggcagcggggaagggaataacagatgaggaggagggacccacacgcggggatcgggcctggggacagacagggggatcgacgaccaggcaccatgttcgcctctcccgccgtacgtctgctttgccctcccgcagctccttccgctaccgccctgctccgttcccttctcgtctcttcttgcgacctcgctctcctgtgcgtcctcctcgcgcccggagtcggtctgttccccgtcctcgtgctctccgcgctgctggggctctgtttcgtcattcgcgtggcggcgcgcgccgtcatcgcggtgtcctcgtccgtccccgccgcgctggtcgccgtggccgctttcctggcgcccgtggtggccgtctgtctgttcctcagattcgggatgtgcggagaaagggacgtccccggttgtcacacgtcccttctccgtcacccccctcggacgggtcggtctgcgcggcgacgtcgcggccgtcgcgctcgccgtcgccgctctccctcttccctcttccttctcgtaccccggctttctcgccgcctcgccgctcccgctcgggggacggagaggaagccggagccctgagagcaggagcaggctccccaggcgcagcagcagctccaagtcgtccgcgatgcgccacagggaggtgtcgttcaggtcaagcgccaggacggggcctccctccgttaggatcagacagacgtgcggagatgccgtgagaaacgcaaagggaagccagccgccctccccgcacagttcgtccagcagcggtctgcacctcgcaaagtcttccgcggcgctgggctcctcaccctgaagggaccgaccggagtcgcggaggccccgcgtcaggtgcggacttgcgagtctgtcagtggcttgctgtcgcccgcctctctccgcctcctcttttccccccgccgccttctctgtcgctgcgttccatgtgtctccggcgtcactcgaggaaacgcgctggaactccgagccggacaggaggtgcgtacacggccacctgcgtctccgatccgtcaggaccagctctgttctctcccactccaacacggggtgagagagctccgagcgggatcccagatgcagtctccacagggcatagaaagcggccaggccgcgtcgggcggttctcgccagtaatttcggcaagaaggccgtgtcgggatctcgacacgtccataggctcggcaggggccgtacgcgccacagcggtgcgcgatagatggcctcacactggcgaaggcccgtctttagaaagagcgacacggagtgcgacaggagatagagtcggccttggaacacgtcgtggcagaacagagaccctcctggcgcttgtaggagcacgagccaaggggacgatcccgttaaccaactgagagacggatgtgccgcgtggaagccgctgcagtgtgtcggctcagaaacgcgcatggaaaaggcggacagcgtgatcaggcccagcggtagcaacttgctgtcggccgaagatggtagggtttagggtcgaaccctgagaccgagagaatagagacaaatgtataaaagagaaaccgaaatgtgcttggtgtagcagacaaaacacaataaatcatgtgaacaagtggaagtgtaaatgtcactcacatagagaagaatccgcgggccagccctgaagaagatgcggttgtcttgttagacaagggtaacgcaggagaaacttgtaaggcttaggatgtaaatgcaggcattcttgctcgggccaaggtaaaggaaggcgtagacctttgtgcaggcgaaggtaggaatggacatgacgaagggagtgtcgacccaacagtagccaccaatagtgggacagcggaagacgatgcagggcgtggctgacacgcgccggcagcggcatcctagaaaacaggagtaagaatagaggggcggagaagtgtagagagaagtggggcgagatggagggaaaaggtgaagttcagaggtggtggtagcggtggcggtgtgtgtgtgtgtgtgtgtgtgtgggggggggcagcgggtggggtgatggtgagtggttgaaagaggggtagtgttagggccagatgcgaggattagtgttagggctatggttagggctagggttagggctatggttagtgctatggttagggctatggttagggctatggttagggttatggttagggctatggttagggctatggttagggctatggttagacctagggttagggttacggttagacctagggttagggttagggttagggttaggcctagggttagggttagggttagggttagacctagggttagggttagggttagggttagacctagggttagggttagggttagggttagacctagggttagggttagggttaggcctagggttagggttagggttaatacccccctttttttaacccccccggggagtttaaagtaatttttgaaacgcgagga

SEQ ID NO: 325 - protein, 156 aa, herpes simplex virus 6B
MLAPPTPRGVYIKGECGALSSSPDLCDSPCRVGIGRCYSNSARGRRCLTDRKYVFFLLCGVSNTERKHIVCDCVHSPILFLIGLKAGRDTVTRTYTHPTHTRRRIDISTAVLLFLFLRLRTPHFFFFVLYFEILVMIFLRSCLWPYIASLRLRRGV

SEQ ID NO: 326 - protein, 169 aa, herpes simplex virus 6B
MSSVVFDEPSTHSPSTRSPSTRSPSTRSPSTRSASTRSPSTRSPCGRRPSPPLARVRIASSVAAALTHRSLERIWVSRALAANPSGDPTRWRSWRPCTDPDGVLGTSTAATVGGSVLPGADSYSRTVWTACREPGAATRSGHGLARGPIAPRRAGSRCVRPSSACVALS

SEQ ID NO: 327 - protein, 200 aa, herpes simplex virus 6B
MSRVFSCVLRACVCAGLCCWVCMGVICGDCQRWWRRRCARWGRVGPRVLDGGAWRVRSGDGVRSVSRTCKTERAPSAARSPVYSPPFVLVSSSSSSSCSSACSSRVPSPPPSPHAASHAVCAEGGRDLPMHGADGDADEGTDGTLLEKGGADEGAGGNATGCPEDTRGFARSPGDLMGEMNGDLGDEGETGEGGDNGEGE

SEQ ID NO: 328 - protein, 115 aa, herpes simplex virus 6B
MVRARVRAMVSAMVRAMVRAMVRVMVRAMVRAMVRAMVRPRVRVTVRPRVRVRVRVRPRVRVRVRVRPRVRVRVRVRPRVRVRVRVRPRVRVRVRPRVRVRVNTPLFLTPPGSLK

SEQ ID NO: 329 - protein, 129 aa, herpes simplex virus 6B
MRPPRCSAPILVCAISMATALSNATVYRDAGTVESTPPPDDEDNYTAKYYDDSIYFNIYDGTNPTPRRRTLPEIISKFSTSEMSRLGGLKVFVPVDYTPTTTLEDIEDLLNYAICDDNSCGCLIETEAR

SEQ ID NO: 330 - protein, 93 aa, herpes simplex virus 6B
MFGDIIICVPLSAESRGVRNLKNRLMPMGLSQILSSGLGLHFSLLYGAFGSNYNSLAYMERLKPLTAMTAIAFCPMTSKLELRQNYRLEKARW

SEQ ID NO: 331 - protein, 164 aa, herpes simplex virus 6B
MYAHTCQPHTHTYILSEQKLWGWKLRNKKIFSRSLYLASLCGTHVFIHSKSSELIVNIELLKIQNHGGQTIKTLTSFAIVRKDNDGQDWETCTRFASVSIEDILKSKPAANGTCCPPRDVHHDRPTLQSSNSWTRTEYFEPWQDVVDAYVPINDNHCPNDSYVV

SEQ ID NO: 332 - protein, 55 aa, herpes simplex virus 6B
PVIFIFFFFFAFSVMHSNIDPAIVSALWHSLPEKLTTTNIKYDIASPTHMSPALW

SEQ ID NO: 333 - protein, 99 aa, herpes simplex virus 6B
MTFPEFFFIFMQFFLIRSTIFVQTGTSKQRFRNAGLLMVNNIFTVQARYSKQNMFEKKIYGYEHLGQALCEGGHVFYNPRDVYFQNIKMAATEPTVVRT

SEQ ID NO: 334 - protein, 490 aa, herpes simplex virus 6B
MFSIINPSDDFWTKDKYIMLTIKGPVEWEAEIPGISTDFFCKFSNVPVPHFRDMHSPGAPDIKWITACTKMIDVILNYWNNKTAVPTPAKWYAQAENKAGRPSLTLLIALDGIPTATIGKHTTEIRGVLIKDFFDGNAPKIDDWCTYAKTKKNGGGTQVFSLSYIPFALLQIIRPQFQWAWTNINELGDVCDEIHRKHIISHFNKKPNVKLMLFPKDGTNRISLKSKFLGTIEWLSDLGIVTEDAWIRRDVRSYMQLLTLTHGDVLIHRALSISKKRIRATRKAIDFIAHIDTDFEIYENPVYQLFCLQSFDPILAGTILYQWLSHRRGKKNTVSFIGPPGCGKSMLTGAILENIPLHGILHGSLNTKNLRAYGQVLVLWWKDISINFENFNIIKSLLGGQKIIFPINENDHVQIGPCPIIATSCVDIRSMVHSNIHKINLSQRVYNFTFDKVIPRNFPVIQKDDINQFLFWARNRSINCFIDYTVPKIL

SEQ ID NO: 335 - protein, 270 aa, herpes simplex virus 6B
MIYKKVHDEQKSLFFHKFKCQWVPRLGSFLPKRVRTLKIANGATAASVFHQKVKGQWVPRLGSFLPKRVRTLKIANGATAASVFHQKVKGQWVPRLGSFLPKRVRTLKITNGATAVSVSPHKVKGQWVPRLGSFLPKRVRTLKIANWATAVSVSLHTVKGQWVPRLGSFLLKWVRTLKSANGATAVSVFSDKAKDQWVPRLKFFLPIRMRTLKAVNKATAFPVFPHKLKGQWELRLKSFLIMRMRTLKSANKATKFLFFFIKLKISGYRG

SEQ ID NO: 336 - protein, 91 aa, herpes simplex virus 6B
VLRNIHTYSYHPDPVVEESIKEILEESLKCDVSFESLLFPELEAFDLFIPESSNDIASKNVSYSSNVEEGASEEFKTLVGEYMNYILYVPR

SEQ ID NO: 337 - protein, 958 aa, herpes simplex virus 6B
MKQELSNMEDDLINSAGLLTLHRSMLEGLVLEQLGQLININLLSSVSSKFVSSYAKMLSGKNLDFFNWCEPRFIVFACDKFDGLVKKMASESRDLLMDLKANMNNQFVIAIKNIFSKAYVALDCEKLNMVSTSLLLMAHNKEMSNPDISNKDFCGRVNLLKQELLESRNEIIENHVKNMKMFQEFANKQMNQIFMDNCDRTFLKIHVNCKNLITAAKNISTAVLQSIVLCSSEFSWQYLKPHRHQFKITIMNMITHACEYLETVYDDTGLIKPLTSSDIMEGYIAINKDRESSICDLNIDPSESILLELAEFDEHGKYSEESSIESIHEDDDNVEYLKYMEVQSPTDNNTPTPSKNNESPTRQKLTNIHEKDVEKMYPDTPSPDVPGKSKEAKTFIENSRQIGKKQTSPNCVCTASVTDLGGPNNFKSITGLESCKHVLIEKLLETQPDSVVVETGSEQQDILAYSPDQRSQTKERIQEKGSNSKCTETLPCMTFTDSATPVKSHDAIQDTLNPESKIDKELGAVESLVNLCDGFHDNPLISEMITFGYETDHSAPYESESDNNDETDYIADCDSTVRTNNIHMNNTNENTPFSKSLYSPPEVTPSKENDKTEKIVPVTQKCKSKKRTAKRKNVPIKPSKSKKIKIDKLPETTNVIVISSESEDEEDGNNNIDSSILKKTIKSEPNSESSSESDDCTSEDNYLHLSDYDKVINNGHCKSKGFVSPVFTIPIRSMPGTHDIRNKFVPKKNWLWFLRKTHKVDNCVIHSSAKMNVKNDSDGTEANHCFINHFVPIKMDDEEYNKDNVSYTYSKIQDSKTDLGVITPTKKLITEMVMENFMDLTDIIKHGIDKHCQDLSSKYTVITSTACEKNLNVTNSQSLVTAETQIFDPQGTGNNSPILNIINDTTCHNDENRCMEGTSNDNEKCTIRSDCNSDKMEVFKLDGYPSDYDPFEENAQIY

SEQ ID NO: 338 - protein, 1513 aa, herpes simplex virus 6B
MKLSGLYHDADVTHRQPLSENTHQDPISSQDSRKNSRTPQDPRRAAQIHRQCTSSASNLPSNGNNSIHMRFASELPDQVLQPMYASQNQTTNSQCNFTSLPYQPNYDAYRSIESSYRESRNTDRGYDSNFRHHSHRPRGGKGKYDSRNYFNPNSKYQQPYGRFFPRSYNRRGRGHRLHDFSNRSADLSYQQYMHPNYEQYNPDLRMNNYKDVTQLTTNFNFQAQDYSMAFSQTSITTDPTYVQSDNHNYPTKSQTTPETTKTKEHENAKDNKEHKKQQVSTSPDAISLSYRPSSQKMDLIKKIYDTEVIPLPKEALIDNGSNCGVDTQKYKKTHIRCRSIQKTKGHSSQTINKHKVQKHNENHVPSRSDLKQRKSNQHEDEAVTEARDFSKLDPLLSPLPMTPEPTLNFAVHKTKIHSNSELHHTKKNIHRSKTSLQDRVLISKHAPRAPTKDNSYKKHHDPKDTNDPKMKHSRGRTTSKKNTANSNGHQDVREVVVKNVSGKAAKNTSKKSDPSHNLHGKTSDEQYKTSPDNEKISTPPKSKTHHCIHDSSSSEEGQYKSPNNSESNYGNCLSDKFYDNFTKTTPNSKTNHKTEESTENTDLNSFSNENTNKTEIEDSNIIQPFSQLFCNETIIPSTSACPTQETPSTMNRNCASKKHSAGANKNLTDNSPIRSHSNPSSFTAFNKSNSGNSTMNSTSNGDECTDMKPNCSSTENKSETSNQTNGENSDKPLSKTFTEVSDRASSRASSRASSRASSRASSRASSRASSKTSSRASSRAFSKASSRASSRASSRASSRASSRASSRASSRASSRASSRASGRASSKASSGVSSKASSRASRRASSRASSRASSRASSRASSRASSRASSRASSRASSRASSRASSRASSRASSRASSRASSRASSRASSRLRQGFQQSLQQGFQQGFQQGLQQGLQQGLQQSSGKTPNNKLMSNIPSPQTCEKTSNKRKPRQICCDSNKRQIYPHDTSISTEAEVSEIKFRFGPELNFYKNTAARLQSFNHNDQFYNPRFRPHIRTNRKKSESTNYTDSESSTSRSRSYSRYSPDSLNTPKRKKHKSGSSSISSSIEENSRSNSRTETGTDKLITFNYQHSRTRSSSASSSSVSSSCSSSRSKSWRKSRYKNSEDPATYSPRSRLQQLEKQTRPKSASRDKTKIKSPNHESKHRHADMFRNSQKTGEKFPLDNSSPSNTHEQSNHLENAIDQEQKKTPKTTNTTTNTIYRPRDNQSNISRNTTKCKKKRTRDDDSDSSMQNFFKKRISGTKKTDSEISEIEEELSYREYVRRKEKKESAKFKIHRGRVSTKDFRKLFRNTIRAFEYKQIPKKPFPENKLKEAVYNICSNGCSNTGAIIMYFTRSKQVAEIIKTMQRELMIRPNITVSEPFKMNHAPPNYYDKDAINQFIELQKQGPQELWDKLENNTHDLFTRHSDVKTLMVYAATPIDFVMASKICNKYAKDKPKEIVLRVCSIIDGDNSISIYNSVSRDFKSKYLTLSKC

SEQ ID NO: 339 - protein, 292 aa, herpes simplex virus 6B
MSPLMLRLLPLLCIIISAHFVPRPETSPSLVYEIGSTVTFHCRLNTTTNIQSVSWYNKSRLISNHEVQNMDNLSGTDDGYVFIHELNKINNLDVDSKLYFHIKHDRTTSLLKIKARSAYDATCLTCTFTVDNEKTSATSCLKLIMKPIVVLYFRYLNNFLDVTCTVTSYPKPNVVIKFLGEVYKRDIPMVRQNENGSSTVSVSFTFKRRTKLEFVGKTISCLASSWFTNQKRSALVTSGEHTVQNHDEYSKEAVKGSNSDETVFTWIVPLILILIISVMVLLISMCIVAFKS

SEQ ID NO: 340 - protein, 342 aa, herpes simplex virus 6B
MKDRGNKNTSKTRQTVKSRRTRKTTKPSTERKKNLTTKTTIRNNRLQNNLSSQTVQTDKPVDSATARAFPQHTSPDIKFNKEKYRNNAIYAHSKLRKISNAVFHQNKEINRFSAFTDKPLADLSFNMPVKTSTTEKKEIVKSTECQRQDPNAVNAFKIFQSYETSPPYSPCSPKNFMSEIYRLFRCYNASIVQIQVYSRNKILINAMQEKLMSIGNMVINVGEQIISESVHHEPVVAIAINQFFRGTVPHTDALRKNAVAPIPVNASKKKLVGICSLMINAPTEKDLLCAAHVCINFAICHPNEITLNIANVTQPMLLREHITIYNSFNKYIYWDDYGKLLN

SEQ ID NO: 341 - protein, 250 aa, herpes simplex virus 6B
MELLLFVMSLILLTFSKAMPLFDHNSFYFEKLDDCIAAVINCTRSEVPLLLEPIYQAPVYNEDVMSILLKPPTKKKPFSRIMVTNEFLSDFLLLQDNPEQLRTLFALIGDPESRDNWLNFFNGFQTCSPSVGITTCISDNCRKYLPERITYVNNFFVDNIAGLEFNISENTDSFYSNIGFLLYLENPATGITKIIRFPFNSLTLFDTILNCLKYFHLKTGVEFDLLKQMEAYNSKLPFRSSRPTILIRNT

SEQ ID NO: 342 - protein, 255 aa, herpes simplex virus 6B
MALLQWMLDHVQDEEKNYENLSIDDQHSLFGINRDWLSFLQLSKLEITHLKHVYKLVDNDRAHLTVHPSSDNVHAWSFLCKPTDVKVVILGHDPYPDGRGCGLAFGTVKECSIPESLKNIFKELERSIPNFSPPDNGCLNSWCREGVLLLNSIFTVVHGLPMSHEAFGWQTLSYKIISRLSEQMNSLVFLLWGKHARKLSYLIDAQKHLVLESAHPSPKVKAARMPFIGCNHFVRTNLFLTEHGKDPINWNILNE

SEQ ID NO: 343 - protein, 662 aa, herpes simplex virus 6B
MHRASANSLLNSVSGSMMWRNQSSGRRPSKRLSDNEATLSTINSILGAEDMLSKNLLSYLPPNNEEIDMIYPSEQIMTFIEMLHGHKNFFKGQTIHNALRDSAVLKKQIAYGVAQALLNSVSIQQIHDEWKRHVRSFPFHNKKLSFQDYFSVWAHAIKQVILGDISNIINFILQSIDNSHYNRYVDWICTVGIVPFMRTTPTAPNLYNLLQQVSSKLIHDIVRHKQNIVTPILLGLSSVIIPDFHNIKIFRDRNSEQISCFKNKKAIAFFTYSTPYVIRNRLMLTTPLAHLSPELKKHNSLRRHQKMCQLLNTFPIKVLTTAKTDVTNKKIMDMIEKEEKNSDAKKSLIKFLLNLSDSKSKIGIRDSVEGFIQEITPSIIDQNKLMLNRGQFRKRSAIDTGERDVRDLFKKQIIKCMEEQIQTQMDEIETLKTTNQMFERKIKDLHSLLETNNDCDRYNPDLDHDLENLSLSRALNIVQRLPFTSVSIDDTRSVANSFFSQYIPDTQYADKRIDQLWEMEYMRTFRLRKNVNNQGQEESITYSNYSIELLIVPFLRRLLNIYNLESIPEEFLFLSLGEILLAIYESSKIKHYLRLVYVRELNQISEVYNLTQTHPENNEPIFDSNIFSPNPENEILEKIKRIRNLRRIQHLTRPNYPKGDQD

SEQ ID NO: 344 - protein, 125 aa, herpes simplex virus 6B
MNVFIEHPVFPPNKLCLFNVFKFTLHPSPQHSQCNENVIRKVYFVSQCNSTCLSDKLSIFRHHGRISTAVQKSFMIFQAIIIRIELFDPIRNIIPISYKNTHHILKINSYTGKAKTCLIGPNTCR

SEQ ID NO: 345 - protein, 344 aa, herpes simplex virus 6B
MASSRVDTINLRIWLVSIICAALSFINVTVHLIAINFPNLGFPCAYFEINDLKAVNLSANNEIYQMTHQLYINPVQIICYVLIMAILFLLIIIYYIVCCAKVFSSNKTSNVNQTTRDITWMGDTSSCFQFILIMDTFQLFVTALSFRLVALGAFAYSIFFVCFTTFNVTLITQFQSADKSFFAFQKIHPNLKGTVQFKTVVINLSELMLGYSTMFLGITTCLGVGNSIYIRSITVAFSSINTFLVMACIYSIVIEAVLVRYVKPLFGYYVGMFCGAVGLSFPILQYETFFESEWSTGLIINLSVVAIISIGFIICRLVRYLVKKKRRYKQLLNAESSSLMDENE

SEQ ID NO: 346 - protein, 305 aa, herpes simplex virus 6B
MLRTCDITHIKNNYEAIIWKGERNCSTISTKYPNSAIFYKKRFIMLTPELGLAHSYNQQVKPLYTFCEKQRHLKNRKPLTILPSLTRKLQEMKFLPASDKSFESQYTEFLESFKILYREPLFLQIDGFIKDFRKWIKGEFNEFGDTRKIQLEPFQKNILIHVIFFIAVTKLPALANRVINYLTHVFDIEFVNESTLNTLKQKTNVFLVPRRHGKTWFIVPIISFLLKNIEGISIGYVAHQKHVSHFVMKEVEFKCRRMFPEKTITCLDNVITIDHQNIKSTALFASCYNTHVSTINSILFSETKN

SEQ ID NO: 347 - protein, 322 aa, herpes simplex virus 6B; identical to SEQ ID NO: 213

SEQ ID NO: 348 - protein, 1345 aa, herpes simplex virus 6B
MENWQATEILPKIEAPLNIFNDIKTYTAEQLFDNLRIYFGDDPSRYNISFEALLGIYCNKIEWINFFTTPIAVAANVIRFNDVSRMTLGKVLFFIQLPRVATGNDVTAPKETTIMVAKHSEKHPINISFDLSAACLEHLENTFKNTVIDQILNINALHTVLRSLKNSADSLERGLIHAFMQTLLRKSPPQFIVLTMNENKVHNKQALSRVQRSNMFQSLKNRLLTSLFFLNRNNNSSYIYRILNDMMESVTESILNDTNNYTSKENIPLDGVLLGPIGSIQKLTNILSQYISTQVVSAPISYGHFIMGKENAVTAIAYRAIMADFTQFTVNAGTEQQDTNNKSEIFDKSRAYADLKLNTLKLGDKLVAFDHLHKVYKNTDVNDPLEQSLQLTFFFPLGIYIPTETGFSTMETRVKLNDTMENNLPTSVFFHNKDQVVQRIDFADILPSVCHPIVHDSTIVERLMKNEPLPTGHRFSQLCQLKITRENPTRILQTLYNLYESRQEVPKNTNVLKNELNVEDFYKPDNPTLPTERHPFFDLTYIQKNRATEVLCTPRIMIGNMPLPLAPISFHEARTNQMLEHAKTNSHNYDFTLKIVTESLTSGSYPELAYVIEILVHGNKHAFMILKQVISQCISYWFNMKHILLFCNSFEMIMLISNHMGDELIPGAAFAHYRNLVSLIRLVKRTISISNINEQLCGEPLVNFANALFDGRLFCPFVHTMPRNDTNAKITADDTPLTQNTVRVRNYEISDVQRMNLIDSSVVFTDNDRPSNENTILSKIFYFCVLPALSNNKACGAGVNVKELVLDLFYTEPFICPDDCFQENPISSDVLMSLIREAMGPGYTIANTSSIAKQLFKSLIYINENTKILEVEVSLDPAQRHGNSVHFQSLQHILYNGLCLISPITTLRRYYQPIPFHRFFSDPGICGTMNADIQVFLNTFPHYQRNDGGFPLPPPLALEFYNWQRTPFSVYSAFCPNSLLSIMTLAAMHSKLSPVAIAIQSKSKIHPGFAATLVRTDNFDVECLLYSSRAATSIILDDPTVTAEAKDIVTTYNFTQHLSFVDMGLGFSSTTATANLKRIKSDMGSKIQNLFSAFPIHAFTNTDINTWIRHHVGIEKPNPSEGEALNIITFGGINKNPPSILLHGQQAICEVVLTPVTTNINFFKLPHNPRGRESCMMGTDPHNEEAARKALYDHTQTDSDTFAATTNPWASLPGSLGDILYNTAHREQLCYNPKTYSPNAQFFTESDILKTNKMMYKVINEYCMKSNSCLNSDSEIQYSCSEGTDSFVSRPCQFLQNALPLHCSSNQALLESRSKTGNTQISETHYCNYAIGETIPLQLIIESSI

SEQ ID NO: 349 - protein, 296 aa, herpes simplex virus 6B
METVYCTFDHKLSLSDISTLCKLMNIVIPIPAHHHLIGSGNLGLYPIVSSNKDYVHIRNVLRTMVVTILQKVEGNQLILRKPMTGQQYAIKNTGPFPWEKGDTLTLIPPLSTHSEEKLLKLGDWELTVPLVVPTAIAAEINIRLLCIGLIAVHREYNEMQTIIDELCSIQYRDVLIKLPDIVNDKQSMYSMKTACISLSMITAMAPDIVRTYIDRLTLEDHSMLLIKCQELLSKRTTLSTQRCGQLHATDIKDELKKIKSVLTMIDQINSLTNEKTYFVVCDVSADNRMATCIYKN

SEQ ID NO: 350 - protein, 492 aa, herpes simplex virus 6B
MLFKNTLAYYDFSITYTQDYKNTPRLNTRVLHPSCKITSSLKKTQYLKSKVKHKMFFCTNMYSPQLNHVLQLVFDCNHIVPNSYQEITLKCRISSTKPGILFITDGTESETEDVLFDVQFLENTMTIKIKILPISRTVPVRIHLFSIPIYLPSPALEIDDINALCQKENIDPIVYEQYGLTNMPISTTNVINQFKVVSNDSVETSLILLNLSWTESPYQSQKLDRYGRKLLIVFSAFSIDTRKCSYWKNLFESMIPLCRVNMISEPGISIYKIEFNDPFLTIFLRNVVLPENERRFPITKECYLRLTFSPPNRSTVTLNMNMPYFKICADGKSLEVFFPSDMSLVINTNKEITLRGKFTNKKIVGIFIPVQTHVFKLYPFLWFAQEPLKLRISCEKTVSVTEHDMLGRIFFVTKKLFRKPFRSLSNSDMKSLLTHTENTDKPFEVHFMGNCFPAYLLPELTLHPLEYEDKPARGNPQILPSVEKHSIIKMRI

SEQ ID NO: 351 - protein, 459 aa, herpes simplex virus 6B
MQPATLQWSSYVLQLRLTTAAILKPGELRYFKCGLGICPPSSSVVCTCRDESSFAASPFTYIDPKDYGNIPFAVHNISDLDLDLGRLPIVLNIFALPYANVTLSNLPVQRIEAYDRHAIPHGQCEAQFILYGPLTRIKIYAADIRWTEKTPEEPTRYLFNADIWINLQNTPLDQIFNSAKIEFISHRHVSISRILLCGNLLILKTVYENDYLLDDTFFPEKLNIQLSLTPHTADITMSQNQETLLKCNVGSITVGATKNIVSNLITPFHCSFHTIFESNSNFTGFFIPKLLHGISITTCIWDETRPLYITMKAQKKNCRINYSQELGKVFFFPKQILPPGNNIEFSWTEMSNIYVNIESPNGPVKDIVALASQPVSRAPSLTTVAHVTPEISMGIFLKSLRIAFDKEHLVPLHFFLKPGESTRMEFMPPETPQSLTILEGDVGIRFIPCHNNYSHRSSP

SEQ ID NO: 352 - protein, 199 aa, herpes simplex virus 6B
MTQIGQYIKLNDAVPNLILHITTKLLRNENLTSFKQEELLLIQHVCTSMLSHGIKILLLRESLYNSGIGDIVILNRKISNNYWFRLFSILKQHSDAELLRHMFNESHSAYISKKLHYSGNVSHIINFLFMDEFGLSLKIPEEIICEGNIVFSVGAIYNHRLLKICRFFNRFWGDQEREPAVRLICKTPMVRLPYNVWKI

SEQ ID NO: 353 - protein, 694 aa, herpes simplex virus 6B
MLFRLWVFVLLTPCYSWRPWTISNESHCKNGNSENPIVRPGFITFNFYTKNDTRIYQVPKCLLGSDITYHLFDAINTTESLTNYEKRVTRFYEPPMNDILRLSTVPAVKQFNLDHSIQPQIVYSLNLYPSHGIYYIRVVEVRQMQYDNVSCKLPNSLNELIFPVQVRCAKITRYAGENIYTHFFTPDFMILYIQNPAGDLTMMYGNTTDINFKAPYRKSSFIFKQTLTDDLLLIVEKDVVDEEYRFISDATFVDETLDDVDEVEALLLKFNNLGIQTLLRGDCKKPDYAGIPQMMFLYGIVHFSYSTKNTGPMPVLRVLKTHENLLSIDSFVNRCVNVSEGTIQYPKMKEFLKYEPSDYSYITKNKSIPVSTLLTYLATAYETNVTISRYKWSDIANTLQKIYEKHMFFTNLTFSDRETLFMLAEIANFIPADERMQRHMQLLIGNLCNPVEIVSWAHMLTADKAPNLENIYSPCASPVRRDVTNSFVKTVLTYASLDRYRSDMMEMLSVYRPPDMARVAAIQCLSPSEPAASLPLPNVTFVISPSYVIKGVSLTITTTIVATSIIITAIPLNSTCVSTNYKYAGQDLLVLRNISSQTCEFCQSVVMEYDDIDGPLQYIYIKNIDELKTLTDPNNNLLVPNTRTHYLLLAKNGSVFEMSEVGIDIDQVSIILVIIYVLIAIIALFGLYRLIRLC

SEQ ID NO: 354 - protein, 738 aa, herpes simplex virus 6B
MLHISRLGLFLALFAIVMHSVNLIKYTSDPLEAFKTVNRHNWSDEQREHFYDLRNLYTTFCQRNLSLDCFTQILTNVFSWNIRDLQCKSAVNLSPLQNLPRAETKIVLSSTAANKSIVASSFSLFYLLFATLSTYTADPPCVELLPFKILGTQLFDIKLTDESLQMAISKFSNSNLTRSLTPFTPEIFFNYTSFVYFLLYNTTSCIRSNDQYFEHSPKPINVTTSFGRAIVNFHSILTTTPSSTPSSTSASITSPHIPSTNTPTPEPSPVTKNFTELQTDTIKVTPNTPTITTQTTESIKKVVKRSDFPRPMYTPTDIPTLTIRRNATIKTEQNTENPTENPKSPPKPTNFENTTIRIPETFESTTVATNTTQKLESTTFATTIGIEEISDNIYSSPKNSIYLKSKSQQSTTKFTDTEHTTPILKFTTWQDAARTYMSHNTEVQNMTENFIKISLGETMGITPKEPTNPTQLLNVKNQTEYANETHSTEVQTVKTFKEDRFQRTTLKSSSEPPTVQTLSVTPKKKLPSNVTAKTEVQVTNNALPSSNSSHSITKVTEEPKQNRMSASTHGEINHTEIPRMTPILNAHTWEKSTTPQWPFTAETSLTTSSKSAILTWSNLLTTPKEPLTNTSLRSTNHITTQLTTSNRTQSAKLTKAHVSSQTTNIYPQTITERSTDVKKKSSTESREANKTLPGNDYRVTDKNSHNHPDNLTTKAYSTQNATHYTYNERHDLNNTDST

SEQ ID NO: 355 - protein, 376 aa, herpes simplex virus 6B
MYSVISEKISETITLQRQTSSRYIEFFVFRNVDINELWTTDISEDKTHDVWPAINEKSFKKFLENELTSYQRPISLLGIPQNGTVSKTCKREKQRETDCVNYVRKHGNPVTFYPRHRAKRNANTDTCISEEPSILVSHHRNSKMDVFMDANKITLVNRELIWVPHDQVRIVKLDISLCIPDGFFGVIIGHSNDVFCECITEIITDETDISVFLMNLSEHSLMLLPGDVEFSINFLPCYIPEPWEMINLSPPESAVFHLKTCREFIIKPNSYTIQCFDAMYVCADELKALMIPSKEIIKLGLLIETYIWNKDTIPSIKIFNSTRKTIYIPTGICIARIIFTCGHFCLSLMPERAINRLQVLDASSFFLFHYAAFSNA

SEQ ID NO: 356 - protein, 860 aa, herpes simplex virus 6B
MTIVVFATEYDAANVIFSILCRSPSEHLIFPIIVKYKPSNNVSFCLQTQKCKNSKRIDTVFVCHAEKLNLSHYIQTASPIKAEDVANSLNDKETELLYVDMILSQTGKEKEDVEFKYMAYFHKSLIIKYLTGKFLLPTSPFWFLSTYGQTEGLLLLTMYYYLFEEQKSTITTTKNYVQCFTENTGSMVFTYSSMSEFINITLKSKFRKLFADFATYARQKNLRDKEEFKYLDTQINLFRKSSHLTNTFRVHYIYIAYNTALETTKFVNYCNITSYDSNLPIGQQCQRNVHILGNSLHENLLCIMKQYFNADCYFKTYIDIKRLKNPDLNVTEYEYALASKKKTIQALTSEQITRAIAKCNKNGEGLFSPVKPGLQGLLEISASDKYVQIQDKRIYRRQHLHKDYHRPFPVFRVQLLHKNIFCFGNSEDWYENMGFNRILQYLPDEYISDEALTRAIWLQDTHFLCDDFEKQFYTTRHEIFNERIPVTNYIGDLDLPLQDTATITEETFFSMCRLIRLTLINAWKKIFPSIDTHTHPIFFFKTQCDTTNDALDYTEDPTEIKQFCICRKKIGLRISIPLPNGTAIAGGEPLKQLSKILNHVMCLDQELSQILNSLTFPGECFDIGIYHTGHCIRIGYMYKTDMDKGKMLHGRLTPIFIVPEGYRNSCKTFIQMQMDLNNLLHHGTKKAPIEELIYSITDKGCPKENLSFMDLKSRQLWNKVNIATDTLITKYLNTHGFNNNATSADDSLLSFIRLIGWPIIKTQLITHYETRIAQQFSQVTFLKIDSKNLQIKKTQFGRVSDFSCLNRQHRGNRDNVLVYIQLKADGNRLILILWSTCFATKCQSNSKQVHCSIALEQLKN

SEQ ID NO: 357 - protein, 516 aa, herpes simplex virus 6B
MYPRGVKRSQHDRHKQTAFRTIKRSITHRPTSKFISHFAKNFRGKLAPLKQLDESRLDALSLTELEQLKTIIEEKQQEKRAQNNAITFLPNLPTVPFADTNFSIKSLGLRPYNGDARDPKQRIRDRFPQTHERICLLTNDILETDLLLRYRQCLDSLTREENQQLMGDRIFSLTNSPCLAFTVATVEEACSYFKFHDLHNLPVNPQDLFMYTITVMKFEFFNKLNMAKLTCVFNDNGHGDIEYRKLRQLCGKPVLDREMPNSEFEVQQQTPDSFRHPIQQAMSIVVTFARILRQIKEHIIRTKKPQFIRDFDTERVAERYECGLISRLIGKQFSNHKCDDVSCQNRIERIMAPWKPSLFFCTYFAKDAPKFKLFPNLPHEYRNLSFTCPKVDMEPSCSYSTSRDLPQTSHRSHKNQGTPKVKSKVCVEKPDTSNLTTTKTTTEILIEESMETDNKIPDPRELNFNQAKQDEIVIININENVNSKHESESSVEMDLDLDYEADTCETNLNTYSSDSE

SEQ ID NO: 358 - protein, 1132 aa, herpes simplex virus 6B
MADENETVVSAPVSTAAWIYVFPKEKELLDVLSVLSLMERNSPVVISPLLMNLTVENDFSTTVKTPITNFGGTILTKITSFMPVCFFFHGTEQLVGMAEDHGDLIRLCEQTRQKFHLQSFEVPTARKVIDIKALCSAVGKDADSVICHVACGNGFKELLFAGLLIPCVEEQIQVQVGEYSCVKIPLYSATLFETEETISLSSCTEFIQERGFFLPALSETLFYYVFTSWGTTLRFSNTKELIDAGLKQFTQDGEQTVKLAPHKTYLGISGQKISAVEKDFLMLVDSVVTELSFSHVAEYLDSVYDPSQIMNFNDWPIIRNSETHAERMAQLTNLKLHLSSHLAVLIFAPNSILYCSKLAFIPNVKQAFNSVMTQELLLRSLSFCNALSSLTEDVYNDNRKIIKCDSTSGKDDKFSANHLAYACATCPQLLSYVVWNLNRMSVYNAGNAYTEIYNHLVNCSANLCEFCDGKCCQSCIGTAMVRVGTRLPAIPKNVKKEPLVMSMFSRYYAEVDILGSFGRKPVSELKEIGKDQQNTLSLDRGKFVSQIFDYCKKNSLIDPVTGEDTFNVRSKKDFVSIIHGLTQCIEECVSRCIVEMRRTQTPREQIENCLQSFNVDTTPYATAFSPFLTFAYYKVILTVLQNLALIVASGHVVDRPCTGNSISKWLVQQYQSLYGTFHSSYLKKGFLNTRTVKVASNVDMEQILDCDLYKSGKYVKTTIQAKLCRLSMQCLRDFRIKNRPFNKSSKTAHNNPYFKKNVKHKKNPLSGCISFLLFKYHDKLFPNVKISCLELWQRFLLNNVPKTLDIGNPEEVKTFIKFAFSITNTYDEIDIIDIQPECLSTFIDCYFHNKFLSALGFHDYLTSLHGLTSKLVTQNPVLFPVVLDKQPKFSSIQEYLVYVKKLVLDGVPNPVIASLSKEPNFGTIFTSRSLVTFGLTLEKFVSLANREYFQFGQLGWIGGSGVDRNLNPTSSALQDFRFMRQKTIIATKFSEVIVKKVRRETIMFDTEVVKGKVLSIVENLTNDIDPELLIIAEVMRDREDKPTMDDMLFFVDGREALAASIMLKLNHLVDMNVRDFSIANLQSVFEAVSSNDAPVYDFSEILAEEDDQASGVLKCDETETETDEPMTKKNRL

SEQ ID NO: 359 - protein, 726 aa, herpes simplex virus 6B
MNSLQSLCVLCARLNECALDLECLKFCDPVIVLSDMANFKKNGIVILHLYQTFFEGIKEQNLLCASALTVYMQVLLKAMYEQVLLLDAALESFMVDQDRKKYFEKVLCLKRCAEHLSINISLNNGVEFIVQLSTLNDIEQLISKINSVYALLLPQEGLQICGKIIDLLTIMCGACMVAKPESYLETKTCMKCYEELTLTPNQGKSLRKRLHGKFCNHLTEQKAFFNIEKNIETIEKDLGEAILNYGTIQSVVTEIKKIFKQQRSAESLHVSDAEKTLKKYNIFSKVPDVIYSLSEFTYWSKISETIVRNVAITLQQLNSCHTLYKQLQNDVSLYLYGEVSEDFLALSENLLTHDERLYVGSIYVSPSRLIDLVTGLSIKNLEESPIFKRLAEEDEVQHKIKSLLHDIRDPQTTETPGRLNTINCMLQTHNLQQEVLARKKAYFQKVSESGYNRVMACIREQESLINKVVSVNVYGNFIFEALSKIMNGFVLRKMYLDGSLRVDSCTYDEHLYIKNNLMPKKLPLELLPDLSEIMYTLLTGPLSDFHKSAYPLPANISMAYGCDHAEMLPHMKEDLAKCIEGTIHPRVWMVCEYNEFFNFSGVTDVNDMQKKMWNFIRELTLSVALYNDVFGKRLKIVRIDEEEDLNGNVVLTFNHESPLLFHTGGGMTKFKDVYSLLYCDLQAQLSRETIDVPEGVSYSVRTPNLLDLVRENEQDDSIIPGCLFDE

SEQ ID NO: 360 - protein, 1012 aa, herpes simplex virus 6B
MDSVSFFNPYLEANRLKKKSRSSYIRILPRGIMHDGAAGLIKDVCDSEPRMFYRDRQYLLSKEMTWPSLDRVRSKDYDHTRMKFHIYDAVETLMFTDSIENLPFQYRHFVIPSGTVIRMFGRSEDGEKICVNVFGQEQYFYCECVDGKSLKATINNLMLTGEVKMSCSFVIEPADKLSLYGYNANTVVNLFKVSFGNFYVSQRIGKILQNEGFVVYEIDVDVLTRFFVDNGFLSFGWYNVKKYIPQDMGKGSNLEVEINCHVSDLVSLENVNWPLYGCWSFDIECLGQNGNFPDAENLGDIVIQISVVSFDTEGDRDERHLFTLGTCEQIDGVHIYEFASEFELLLGFFIFLRIESPEFITGYNINNFDLKYLCIRMDKIYHYEIGCFSKLKNGKIGISVPHEQYKKGFLQAQTKVFTSGVLYLDMYPVYSSKITAQNYKLDTIAKICLQQEKEQLSYKEIPKKFISGPSGRAVVGKYCLQDSVLVVRLFKQINYHYEVAEVARLAHVTARCVVFEGQQKKIFPCILTEAKRRNMILPSMVSSHNRQGIGYKGATVLEPKTGYYAVPTVVFDFQSLYPSIMMAHNLCYSTLVLDERQIAGLSESDILTVKLGDETHRFVKPCVRESVLGSLLKDWLAKRREVKAEMQNCSDPMMKLLLDKKQLALKTTCNSVYGVTGAAHGLLPCVAIAASVTCLGREMLCSTVDYVNSKMQSEQFFCEELGLTASDFTGDLKVEVIYGDTDSIFMSVRNMANESLRRIAPMIAKHITDRLFKSPIKLEFEKILCPLILICKKRYIGRQDDSLLIFKGVDLVRKTSCDFVKGVVKDIVDLLFFDEEVQTAAVEFSHMTQTQLRDEGVPVGIHKILRRLCKAREELFQNRADVRHLMLSSVLSKEVAAYKQPNLAHLSVIRRLAQRKEEIPNVGDRIMYVLIAPSTGNKQTHNYELAEDPNYVLEHKIPIHAEKYFDQIIKAVTNAISPIFPKTDIKKEKLLLYLLPMKVYLDETFSAIAEVM

SEQ ID NO: 361 - protein, 105 aa, herpes simplex virus 6B
MDSSPEKTNLELLYEQVCEQGREFEVVFYPMLPRLYEMMLPSLEARLNFLSVGYRHVAFSRYVHGDVDCVHREVMAQKIILLTSILSKLLNVNGILEHQEYLNTE

SEQ ID NO: 362 - protein, 470 aa, herpes simplex virus 6B
MFYLKKLLRQLLARLCKHGPYTHLQLFVMGDACVPGKCVLTMFLTNKKFLNKEVTEKFYNEFFAIWLRCRPETRFITKRLFNKMVMTKGLFVLLAYLYFVYRQCKVLELLSLYKLKRIKWMDVETRFRVYPSYKLNKLLEMPSFSEINELHMFLFEQQLLLPIPTHVNLPCMRLFCLRDYEQTETVMLRYRQREHVLSFPSMLQKYALKSPAGNFMFTMAKALVENFCFSADRYLIPVEHNNLVPMVPSKPERGDFPKILTFALATSLKDGLATSVISLPVMCYCKTKCSRFILEESYICVICAKCGHCLNSGKEKLCSPQGFSLSSMFYFRDKQEKNLIYSMHTDVMYCSLCGSQQLVFERIYEMSEHCVLGMKVKTVSWKAVIGTNSACTILNDNVKFDVIVPCSCRSCYSTVHLYNVTVKKLLRLVSHGSDFQCQHCQHSFRETCLDLEDCVNICQGCQISQNVRCI

SEQ ID NO: 363 - protein, 89 aa, herpes simplex virus 6B
MTTIRGDDLSNQITQISGSSSKKEEEKKKQQMLTGVLGLQPTMANHPVLGVFLPKYAKQNGGNVDKTAFRLDLIRMLALHRLNTKTGSD

SEQ ID NO: 364 - protein, 299 aa, herpes simplex virus 6B
MNSKSSARAAIVDTVEAVKKRKYISIEAGTLNNVVEKERKFLKQFLSGRENLRIAARVFTPCELLAPELENLGMLMYRFETDVDNPKILFVGLFFLCSNAFNVSACVRTALTTMYTNSMVDNVLSMINTCKYLEDKVSLFGVTSLVSCGSSCLLSCVMQGNVYDANKENIHGLTVLKEIFLEPDWEPRQHSTQYVYVVHVYKEVLSKLQYGIYVVLTSFQNEDLVVDILRQYFEKERFLFLNYLINSNTTLSYFGSVQRIGRCATEDIKSGFLQYRGITLPVIKLENIFVDLSEKKVFV

SEQ ID NO: 365 - protein, 804 aa, herpes simplex virus 6B
MKRKERRINKDFGYNRKCVCHYEASQKRFCYSQYSCASVLYERVRDIAKIMDRLDSGLDAWCLRDAIISVLRATHCVPRVDRMLGRWYLKTSIFYDFCPDDLILSCPNVIMPNVLNFVKKYRDFIRSVLYKVSVSWKNQYMPGVLGASRFLEEISNSLNGVEESIPCIYLRMCATLTEIVLRNGYLREIYQENPYVIFEELAFSLFTQKWVLPFSCMTNLGLVEKANSTVFDVAIYNTCLYSLADFITVNGEHLFPALLNGSNISMNVTRYQQEAKNIFEILLSQIQVVERDTDKTVQLTVYVEVWHVSALTWLDLYQVLPETSRVTFCLIIPGIFMDRYELKRAQWSLFHKNIAFELGKCDEVTFSTKYLEFERTTDHAKITMASFVEKICRCLKRGRMGLIFRKNVYQYSMIPHVPLYCGGDFLDVLPVRDGINTCLRMLLNVVHFLGDEVSDELTEEIDFVRLQCKFFMFNELRRVVRKMVLVANAVIDYAVENKDFLREGIVDGRSLGICITGLHSVFMTVGLSYAHPDACRLYRMMCEHIYYTCVRTSVDCCMKGAEPCNLFDRSKYALGMLYFDQFDNVECTLPEELWTTLRKDVLMHGVRNIHFTAGTAMQKEFDIINSSESFWPMEDNKILRRSNIKVVIGKDGLNDVTSVYSSELKSLYIPVYNNLLLNRFNKHQQYLKTVGYRVLNVDTNLFTDKELDDLAVFKDGFSYPLNDLIEMYKSGLPFLDQGQANVFYFNDTVSLKHLLPLLYKTGFKVAMYKVLCSSEMYKHLDLSNPLPLIGKCSDGVVMHVKNIL

SEQ ID NO: 366 - protein, 295 aa, herpes simplex virus 6B
MRRLTDSFILGLAKGAVIPGLYPFRMTEGRSSLEQIGVVITVAISFLLTFKKFDPRFYKPIGDFKIVFLSLMAAKLPSFLSAVVMICLIFSEMRLRMILSRCVLIMPSYSPAVFTGMMVSLFFKSQMFDDYSVLTTTAFLLPFTLRYGWMIRSSGFLISLQKYRPILKSTSFREVDLKYLVKFTVEFLLLFTILWIGKIFLSMPKSNHLFFLTVVNNVFFKLNVFKAAACAMVAILSGLMMNVCLYRIIFEAFLGLGFSSIMLTLSSDLKDRSFYAGDLLNGFFCLVVCCMYFGV

SEQ ID NO: 367 - protein, 316 aa, herpes simplex virus 6B
MGLSSSKDIDLLVNFIENRQGATLALPWPEDYRLTLHSVENIPDISREDVQNWAKTYMCCEGELVVVGVIHKAKTRTCRGPIVLQGARGHIYVYNGFFDRSLYHVASSFHDLFSNGLRFFYPIYETCDYALDSTVALDMIAHSKSFSELLHYRNERKNAFFTLKTYPYKTFVRFCNLSMTGFSSKHLIQWRRKLQTSLLDVVFIVQHNFFGDWRELVVVFDGHGMLFCVDREESLLFIARNMSDFLKIGCLRYNENRRLHTQWFTQDTDYIKQVDEMFSRDVLCPLREHCQRSRRDRGLLKICTSLVRGINCIERG

SEQ ID NO: 368 - protein, 88 aa, herpes simplex virus 6B
MDRPRTPPPSYSEVLMMDVMYGQVSPHASNDTSFVECLPPPQSSRSAWNLWNKRRKTFAFLVLTGLRIAMILFIAFVIYVFNVNRRKK

SEQ ID NO: 369 - protein, 299 aa, herpes simplex virus 6B
MRKSEFNAKSCFLMIGICVFNLNSSSCIIKTNAEHCSKRLFSFCYLGVGVIKKPLHLGNRKNMLFLSFLLVCLCEEVQMLNLTTTEVSATEFASIASKNMETNVSTSSDYLTGKSETTFSANPETWGKNVTEISIASVAYLNQSSMVTSTLAVGTTNRSSGNNVNVTTSSFPTVKGDEAQDIETFFTVILASTLSDVSEKTPQGLPTKSTPKKTVHALWETDTVQVPELTDTNEGDEEYFKDFLSSLVIWICGISFVGAFIIVIVILYNWYKKDKQRSLLWDEENKPDVQIRRDAKTCR

SEQ ID NO: 370 - protein, 500 aa, herpes simplex virus 6B
MSALFITASRFTFLLLWFFVLAGLLWILCLICGRNPSTLWYDGDLILKIASLELVGASDRKREGKRSMMICFVFLCVLTFVRGEIYPSTCPALGAGNGEAVRSGEMLLEISAYRNWRSGKMELWGSAAVNNQVFYGGMEDSQIEYDFGKFLVFRCFQVFHNVHKLLFNTVSSATMHLARKRVQKCGHGKMTFISIQVQCSVNKKSIRLSRMNETNLKKQVLRVAFFLDGSNNSWIADKNFQGEDRTMLRLWTELSTYRQYLISSCNNDVKVLSELYGEFRRMALSYDEELKLNFMPVIRSSSERLFRADDLKCSFSRWLGAEGEFAVCEYSGWGVSKLGKIEIFAEEPLTFDMVWKTVKMRSSGAYTSLFRDDVTWGLISLDKWVGDKYFCMCTNKESGDNVIVTLPEKNVEKSIQIYNEGSTMLAFAEITSIMVNLMFMGAVAVCVGILGISCFVGLKEIIYFIFVSVNSMWPFCNKLLTTAVNCFFKGRTFLRRELKI

SEQ ID NO: 371 - protein, 434 aa, herpes simplex virus 6B
MITVFVACLFQCVSSLPAKLYIKTTLAEGIGKLQTVIGIDNDIVFAYERLYGDLTLRNHTAVGETLFDLAGSLEEGKNSTVDRFLGHVVIREFHRLHAGLQYVSVQNFSVSELVCFVNNNTQLSGSYVFLARNTTYVQIDLFNENRSFVHDLINVSSFLQNRSLHVLSFYARRFCVEDILNFYGKVVFGDSKYRPPQVFSKRDTGLLVCTARRYRPIGTNIQWSLHNQTVSDDHTTDDFIRTEISGQLLYSYERALSRALSMTHHEFSCEITHKLLVTPALLTREDAFSFKGFVNPVKESEDTFPRHNFPAPHRKKFNKLQLLWIFIVIPIAAGCMFLYILTRYIQFFVSGGSSSNPNRVLKRRRGNDEVPMVIMEVEYCNYEAENHDMELHSVQNVRDDSIAVVCGNNSFDIERQSIKSHESFSNVKLEMLPL

SEQ ID NO: 372 - protein, 389 aa, herpes simplex virus 6B
MAFTGDELARMLQFKDKMISSAGSALRFEKVVQEAMASGIVLQHITCIKVRICDNSDILSDRQLRCLLINGLYPFEGRMSMFGVTEEWEGASAAPERQVVFLLSSTGQVLGYEDGVIFYLSPTFSDFWTTAMEFSCQNAILSNFIAQKSRDEYSDQFQKYFTRMRHTPISLTGVLPRRFQKVESGACVEEDARASMRPIQSDSFGAKGPFCWPTEELLQPSAKKDVGGTVCMALSCQEDNSARHCTIYGLTKTPGIKIMLSRHTQTDRSEAMCDAATQTEDVVDNSSETLFLGGNLVHQSILETEVQATAKNTFDVSDPRIDSVYDTTVVGAMATDDVGCKHVQGGASLAQEKPLKGYCIIATPSECKPNIHWLKSPENAVHESAAVLR

SEQ ID NO: 373 - protein, 294 aa, herpes simplex virus 6B
MKKLTMESLLVYTFVMGVCFTSNLTCEQKIVLIQEQKLGAICISTCYVNGVLAGNSSCVSVRTSYLINLAMLTDGFKAMKVGNITSISEKTAFLRVIINYYFRGVMLRALIAKRLPNAAQLSSTVNCWLEGHSAGGVMTLFYGTERIVLKSSTEMNASQWTSDGPDANGTLNILNERVSLDSYFLSMICPQLSDEIYKKKVVHSKYFSLIKNDTMPKKFLRNTWKSAWTNWYKYKEIEALLDFSRDYENVSEITHSMSAAGLFFLAGGAFTMLLLLCCLSMITRKHVVKDLGYK

SEQ ID NO: 374 - protein, 86 aa, herpes simplex virus 6B
MADERIGDYVKTRYDIALMNLNDIKIAVFRDSLSTYVEQKTGLTIQFNWPKSRCLVISTLCKIPFPTKSAAELQEMCKYQCFVSVL

SEQ ID NO: 375 - protein, 143 aa, herpes simplex virus 6B
MKSCLENNDGVFVLFLTRKEDFPSRMEWNFFSDVYESMPYHGHVIGSIGKTLLYPKTMFVMMDLSGAIYGIDTIGTGIGSCVKIADEFESFLRQGIVRGYRRYKFFHQNISTVQEILPLCPHTFLGPTFSNDYIYDLSSEDEE

SEQ ID NO: 376 - protein, 110 aa, herpes simplex virus 6B
MDVWKRQRLQECRELCPLPVLMSLSNILSNTEIIYVKYLFKMDFSTMYRFILPALTLSMTVTKSVVIEMLFILKRWEEINQFFRLNIRKVNDCFVVAQFTNIPVKRWVLI

SEQ ID NO: 377 - protein, 858 aa, herpes simplex virus 6B
MDLKAQSIPFAWLDRDKVQRLTNFLSNLENLENVDLREHPYVTNSCVVREGEDVDELKTLYNTFILWLMYHYVLSKRKPDYNAIWQDITKLQNVVNEYLKSKGLNKGNFENMFTNKEKFESQFSDIHRALLRLGNSIRWGSNVPIDTPYVNLTAEDSSEIENNLQDAEKNMLWYTVYNINDPWDENGYLVTSINKLVYLGKLFVTLNQSWSKLEKVAMSQIVTTQNHLSGHLRKNENFNAVYSQRVLQTPLTGQRVESFLKIITSDYEIIKSSLESYSASKAFSVPENGPHSLMDFASLDGRMPSDLSLPSISIDTKRPSADLARLKISQPKSLDAPLKTQRRHKFPESDSVDNAGGKILIKKETLGGRDVRATTPVSSVSLMSGVEPLSSLTSTNLDLRDKSHGNYRIGPSGILDFGVKLPAEAQSNTGDVDLLQDKTSIRSPSSGITDVVNGLANLNLRQNKSDVSRPWSKNTAANADVFDPVHRLVSEQTGTPFVLNNSDVAGSEAKLTTHSTETGVSPHNVSLIKDLRDKDGFRKQKKLDLLGSWTKEKNDKAIVHSREVTGDSGDATETVTARDSPVLRKTKHANDIFAGLNKKYARDVSRGGKGNSRDLYSGGNAEKKETSGKFNVDKEMTQNEQEPLPNLMEAARNAGEEQYVQAGLGQRVNKILAEFTNLISLGEKGIQDILHNQSGTELKLPTENKLGRESEEANVERILEVSDPQNLFKNFKLQNDLDSVQSPFRLPNADLSRDLDSVSFKDALDVKLPGNGEREIDLALQKVKAGERETSDFKVGQDETLIPTQLMKVETPEEKDDVIEKMVLRIRQDGETDEETVPGPGVAESLGIAAKDKSVIAS

SEQ ID NO: 378 - protein, 411 aa, herpes simplex virus 6B
MRRKACESKRGLKFNKVCHTTLFFPISCHVTASRIEVLYFRYFIVSLLVLFGVFKMDLEAKEVSGEIPNENALAELCRFCESADLSRIENFVGTYKNWCLSIIWPRNCWLRFTLRKDVAGYTEKMFEDMNDHYQGFVEKLCLLGTIQIPYRDVPILIGRSKRIFLHDLETDTLHFVCDNFEQFVRYGVLGTNIITCAEPVYRHGLYDGPRFESLENLRNNDVLRSPCTLNVHLKLNRKGVLGIKAMRKHYIAMLREFDELARCASLDDVERFVSLNVGRDLRLDMPVFKSLTLGTRDSVWIGTCRLANLEEQEDLVEKVVVLGYLNDHDYESKCTRPILCIGKSGKIYYYDWIDNVLVKLGDCLLTFLRVGFARLFADCGYEKIGKISMRFGRMSTLGMSETYQSCMSLSK

SEQ ID NO: 379 - protein, 374 aa, herpes simplex virus 6B
MSNFRLILETEGGKRVLCESIVLHFAFMFQTEIVPVCNDEFTLSSCVPTLDFDVDVLSAAYGDGLEISSPGLRCCIAWPPMYALTLGEFYHFHTHRWVSAYDWSSLLDTDEFLSAIGYAHPIYRDPNPDYDPYVMHSSTGKTIAVDTVTEKVYIIAESLVQFFNIGLRQFPPFAEAELDPEQEKMWFGETKCGREEFILLQRNLPAMKDYVAKHCGKRIRVDAFQDFDFSFCSLSDIYYLTGPGILEKITEKDYAIIGTCARSQAEPNCRAAIVMGSNCHIYIYVENRISKVSKSLRTFIRRGFDELLYKEKYSLDWNDDTLFYISDTETENLNRMLNGELPVLRSKPRHMCVRKDRWVDVLCVVFPEKTILRG

SEQ ID NO: 380 - protein, 443 aa, herpes simplex virus 6B
MVKNLKFMDNFDEKWQCITKLAFIGLYAGASLFNFASKPTLGYWCRYLCEYASMLLFQFESKLKELTKESTRQLGGYNLCHWGQELKDCLENKSDVFFRYDFFERIESCLIEHFMLLCGCVECRRMFIMYNKRGRKCDFGHCVRIQCFPMIGSIRLPAFLHLGEPYSVSLSSLIAKDLGLSMIEGQIEHSRLPISLQISVTPDKKALLTFLTNIVFIVFVVNTLYRVINAELDIYYDLFTEEVGKLCVTMEEEMKLGRNGCLGDLCYFSSMKQMKEIVRCPGEKSQFILKCWEALRIGFSVPAYKDYDETRFMEMFFLHHLHIKRFHEHNDRDLVSSDNLIPGFFIVNTHEENFLQRLQRVVLPVAEDYLTNTRCINGTMAFFFSGLKYFGSGNHRGVQISPEKDVRAIGYKLGSLDVLRDDYKYYEYAPDCAGELNGHDGDE

SEQ ID NO: 381 - protein, 535 aa, herpes simplex virus 6B
MELLDHDIYKGPVRERVTYTIPNHPYLSLTVHHSRELDVDLKDITEEMIIDSGTLTAEDLFMTRGLRFCDDSVLWAALAEKVSVEFQRRGKTTMDLSAFMSLLERLTFEDETSAFYRLLTKCTALAHFSILEYIVDGEKRDTISAHFNRLLELLDSLFLQFLMLRNRSESNTLLTLFDILPNPKEIYGDAASPTSVLLKHFLSDYIFVAYASSYRFVSSVLCSCDQCRASLFRIYLGKKDSRAVNISDISEFDPADLILGQLHLDAREAVALRAEIDRDLGSSLILNSMERRHLPILHDKQLGRGHFERNILKVYCNIVLCLFLLRRVKQRIVSDLTAIARFFVKAISEMERCIDTVSGLHGVRIKLLVVSSQFEIKDPMRVPRLCFFFLEIVTILVSGYDKERHRVRALLEHLCLKKICLGDLCASMRLAREIRHDVLEGFLNTLELSYMSNPVRFFRFHDCNLYGTHMWSGVYPNVVPYAVAGGGSFDIRLQEHRRRQKRIVLRRRLIRRVQQRGLDIREARRVPKLACVTFI

SEQ ID NO: 382 - protein, 386 aa, herpes simplex virus 6B
METTNSRRVSSAQRQILATATVRFIEGLHEPAQDSMMCGDDELQSQERMKKRPRLYNKSKRDLVDLLRVYTCLNSVRMFTFVNFGRRIPLAWPEGYELVINNCRDENEYADEKLGGLADLVCFRERLVVLGHVKKRGEIGSEPAYWFLKGDIVVLLGGAGRVYAHTWLLPQQLCRVGDTIDDFLRKGLKRFYYAHQLVSSLQFVVEDTEVDGVCSCRDVLCFRDRHIGRSFALRWPKNETLLFHRRRDSFVFVRCDEARRRLAEMCFFGSFGYKYFADAGRISLYVADDGRIFGFNDNDEDGRPRFVAENFQQFRRIGVIQYYKSYVFRREQPEWALLPTCHLSRMFYQKTWRQADDDLLFVKARNDERQEFPDAGTRSAVHDVVR

SEQ ID NO: 383 - protein, 433 aa, herpes simplex virus 6B
MCSQFCGRSVHFHFRGRRREYVDSTLFVSNSCSVLNVIVDVYVRLPVTLPLSFFFFFILLILSRIPHRKKMFCRSPFLGISSWSLASAALCPSSCSFSAGRDLRCDAAVPEVKWTAFVRTLVARPLSADDVRDFVSTFAHCRLALSWPVGAELRFATSDMLGITQAELAKLSRGYGCCPGMDLTVIGVTIFAEVSALVLVGECGEIYAFNGVFDDALYRLAEDAFGLWKHGLRRFEPVYGSKCLMETGASFFGGMSGVDDALAFAVSFDKALVPLPWPRGAFFEFAVPRRAEKRWRLIPGGGVAVVIGRFFGRGVTLPLLRRQRVLMDQVGRVYAASLDGGAVVRLSDSFRAFLAMGVRKLFKNHRFPPGHLWTMQLPVTCVHAPVINLPAVYQLSPHMVEREMSAVSCGASTVVRRDCEDTLRDGDAGVDTS

SEQ ID NO: 384 - protein, 171 aa, herpes simplex virus 6B
MALAAVLSFLRRLLVCPSAALPSASLSLSRAPSFFRSHRAPAPGCTFAFKLHAIHPHTLARSLGGGGGGIPGAGRTGDTRGRLGPVREGRFFHAPLAVARVLVKNTAPPIEARARALGDGLGLGLGLGLGLGLGLGLGLGLGLGLGLGLGLGLGLGLGLGLGLGLGLGLGL

SEQ ID NO: 385 - protein, 156 aa, herpes simplex virus 6B; identical to SEQ ID NO: 325

SEQ ID NO: 386 - protein, 169 aa, herpes simplex virus 6B
MSSVVFDEPSTHSPSTRSPSTRSPSTRSPSTRSPSTRSPSTRSPCGRRPSPPLARVRIASSVAAALTHRSLERIWVSRALAANPSGDPTRWRSWRPCTDPDGVLGTSTAATVGGSVLPGADSYSRTVWTACREPGAATRSGHGLARGPIAPRRAGSRCVRPSSACVALS

SEQ ID NO: 387 - protein, 200 aa, herpes simplex virus 6B; identical to SEQ ID NO: 327

SEQ ID NO: 388 - protein, 115 aa, herpes simplex virus 6B; identical to SEQ ID NO: 328

SEQ ID NO: 389 - DNA, 315 bp, herpes simplex virus 6B
  CDS (1)..(315)
atggctgttagaaagttatggaagacagtcgtacagctgttttctaaatcgaaatccgaggagtgcaatacagaagccggaacgatggaggtctcctgcttaaagtacggggtgcaaggtttgaatgcggattgcagctatgtcaaatcgcaatgcataaaactttcggaatgcgagtgtttatatacttttgcttctgatgtatgtaaggaagattttcataattccgaggaaatgaaggtgtttgttgtccaacattcgcaggaaatcgttggtggaacggatttttctgtacatgcggaggaaagcgtgtga

SEQ ID NO: 390 - protein, 104 aa, herpes simplex virus 6B
MAVRKLWKTVVQLFSKSKSEECNTEAGTMEVSCLKYGVQGLNADCSYVKSQCIKLSECECLYTFASDVCKEDFHNSEEMKVFVVQHSQEIVGGTDFSVHAEESV

SEQ ID NO: 391 - DNA, 609 bp, herpes simplex virus 6B
  CDS (1)..(609)
atggtgcctcagggttggagtttagcatgggtgagtgtattatacgtgtcggtgatagcgtctttgcatattattaacaatgaaaattcagtttttatcggaacacatagtgaaacggagttaagacattggttgatttttgtaaaaatggctcagagaagtggaactgcttggtggcggatggctagtgtgcctattaatgcttatttcgaaagagatatagcctttttatttaaccctcgatgcgttatcgagactgccatggggtctaagatattatgtcgatacaataaaaatattggtgttgtgtttgtggacaatgatactacgtgtaatgtttcctttccgagcggtgtgcagttacaattactaaatcaatcggtgatggagtcaattagaactaaaacgtatgtagtggattacgctaggaaaactacagagagaggtgattgcttcatttctgtagcattctgccgaaaagaaagaagacgctttttaccccgctatgagcgctttgtttattactgcatctcggtttacctttttgctgttgtggttttttgttcttgctggtttgctttggatcctttgtttaatatgtgggcgtaa

SEQ ID NO: 392 - protein, 202 aa, herpes simplex virus 6B
MVPQGWSLAWVSVLYVSVIASLHIINNENSVFIGTHSETELRHWLIFVKMAQRSGTAWWRMASVPINAYFERDIAFLFNPRCVIETAMGSKILCRYNKNIGVVFVDNDTTCNVSFPSGVQLQLLNQSVMESIRTKTYVVDYARKTTERGDCFISVAFCRKERRRFLPRYERFVYYCISVYLFAVVVFCSCWFALDPLFNMWA

SEQ ID NO: 393 - DNA, 1176 bp, herpes simplex virus 6B
  CDS (1)..(1176)
atgtgttggtcatttcatttgttttttaaagcacagaaggcgcgagttggtgctaggacttcgttcttgacagagatggagcgcggtagtcgagatcatcatcgtgatcaccgtgatcatcgggaacatagagaactgagagaaccgccgaccctagcttttcatatgaaaagctggaaaactattaataaaccgcttaaagcgtttacaaaactgttaaaagagaatactacagtgactttcactccgcagccttcgataataattcagtctgctaaaaatcatctcgtgcaaaagctgaccattcaggcggaatgtttgtttttatcagatacggagcactttttaacgaaaaccattaataatcatattccactctttgaaagttttatgaacatcatctcgaatcctgaggttacgaagatgtacattcagcatgatagtgatttgtatacgagggttttggtgacggcttccgatacatgtacacaggcgtcggttccctgtgtgcatggacaagaagtggtgcgagacagcgggaaatcgccgttgaggattgaccttgatcattcgaccgtttccgaggtgttaaaatggctttcgcccgtaactaaaactaaacgctctggtaaatctgacactttcatggcgcacattatagtacaggttaaccccccgactataaaattcgtgacagagatgaatgaactggagttttcaaacagcaataaggttatattttacgatgttaagaacatgcgatttaatttatctgccaaaaatttacagcaggctttaagtatgtgtgctgtaatcaagacgtcgtgtagtttacgtacggtagccgctaaagactgtaaattgatcttaacttccaaaagcacgttgttgacggtggaagcatttttaactcaggagcagcttaaagaggaatctcgctttgaacgaatgggtaaacaagatgacggaaaaggggataggaatcataagaacgaagacggaagtgcgttggcatcaaaacaggaaacgcaatataaaataaccaactacatggttcccactaaaaacgggactgcgggctctagcttatttaatgagaaagaagatagcgagagcgacgattccatgcattttgaatacagctccaatcctaagagacagagatgcgtcgtctga

SEQ ID NO: 394 - protein, 391 aa, herpes simplex virus 6B
MCWSFHLFFKAQKARVGARTSFLTEMERGSRDHHRDHRDHREHRELREPPTLAFHMKSWKTINKPLKAFTKLLKENTTVTFTPQPSIIIQSAKNHLVQKLTIQAECLFLSDTEHFLTKTINNHIPLFESFMNIISNPEVTKMYIQHDSDLYTRVLVTASDTCTQASVPCVHGQEVVRDSGKSPLRIDLDHSTVSEVLKWLSPVTKTKRSGKSDTFMAHIIVQVNPPTIKFVTEMNELEFSNSNKVIFYDVKNMRFNLSAKNLQQALSMCAVIKTSCSLRTVAAKDCKLILTSKSTLLTVEAFLTQEQLKEESRFERMGKQDDGKGDRNHKNEDGSALASKQETQYKITNYMVPTKNGTAGSSLFNEKEDSESDDSMHFEYSSNPKRQRCVV

SEQ ID NO: 395 - DNA, 831 bp, herpes simplex virus 6B
  CDS (1)..(831)
atggctaacgtactcaaagaaaagatgtacgatgaactactgagtgcgacctgtcgtatcttaaagttggggtctcatgactataggatgactgagcggaatttattgtcgaaaaatccgaaatttcctttgtgtgatattattctcaagttagactacgcttataatctagaatatctgttgagtctctgggaacatgtaactaagcaggaaccgagatttgtgttcaaaaacacaggcggacgtgtgtcgatgtcttgttatttgcatgccccggttaaagcagaaggccatcatgctgtgagagaatgcaacattctgcgtgttaatgaatgtttgactgttcgcatgagcgacatagtggctatgaagccttcaacttttgcagtgttcacgaaatgtataattaggcgtaatcgagacgaaacttacgttgtggagtttgtggcgtttgggcctgaaaacgaatctgaatacatttcgcttttgaaggcaattttcttaaagaagtgttctatggggaaacagcatctcgaatcgaataggttttgtcaaggtttgcgaagaaggtcttcacatgttttggaaaaggggcaactcggaagtagcggagaaattgcaaataaagcttctgcggttgtgacatcacaggagagtataaaccagttctatgaaaaagaaaagtcattcctgtccggtgtgaagttttcgagactaagtgaaaggcattgtcgggttgcgattgtcagcatctgctttcttttagccttgtatttttgttatgttctacttaaaaaaactcctacgccagcttctggcccggttgtgtaa

SEQ ID NO: 396 - protein, 276 aa, herpes simplex virus 6B
MANVLKEKMYDELLSATCRILKLGSHDYRMTERNLLSKNPKFPLCDIILKLDYAYNLEYLLSLWEHVTKQEPRFVFKNTGGRVSMSCYLHAPVKAEGHHAVRECNILRVNECLTVRMSDIVAMKPSTFAVFTKCIIRRNRDETYVVEFVAFGPENESEYISLLKAIFLKKCSMGKQHLESNRFCQGLRRRSSHVLEKGQLGSSGEIANKASAVVTSQESINQFYEKEKSFLSGVKFSRLSERHCRVAIVSICFLLALYFCYVLLKKTPTPASGPVV

SEQ ID NO: 397 - DNA, 2493 bp, herpes simplex virus 6B
  CDS (1)..(2493)
atgagcaagatgacagtattattcctggctgtctttttgatgaatagtgttttaatgatatattgcgattcggataattatatcagagcgggctataatcacaaatatccttttcggatttgttcgattgccaaaggtacggatttgatgcggttcgacagagatatttcgtgctcgccatataagtctaatgcaaagatgtcggagggttttttcatcatttacaaaacaaatatcgagacctacacttttccagtgagaacgtataaaaacgagctgacgttccaaaccagttaccgtgatgtgggtgtggtttattttctggatcggacggtgatgggtttggctatgccgatgtacgaagcaaatttagttaattctcgtgcgcagtgttattcagccgtagcgataaaacgacccgatggtacggtgtttagtgcctatcatgaggataataataaaaacgaaactctagaattatttcctctgaatttcaagtctgttactaataaaagatttatcactacgaaagaaccctactttgcaaggggtcctttgtggctctattctacatcgacgtctctcaattgtattgtgacggaggctacggctaaggcgaaatatccgtttagttactttgctttgacgactggtgaaatcgtggaagggtctccgttcttcgacggttcaaacggtaaacattttgcagagccgttagaaaaattgacaatcttggaaaactatactatgatagaagatctaatgaatggtatgaatggggctactacgttagtaaggaagatcgcttttctcgagaaaggggatactctgttttcttgggaaatcaaggaagagaatgaatcggtgtgtatgctaaagcattggactacggtgactcacgggcttcgagcggagacggatgagacttatcactttatttctaaggagttgacagccgctttcgtcacccccaaggattctttaaatcttaccgaccccaaacaaacgtgtattaagaatgaatttgagaatataattaaagaagtctatatgtcagattataatgatacatacagcatgaacggtagttatcaaatttttaagactacgggagatctgattttgatttggcagcctcttgtgcaaaaatctcttatggttcttgagcagggttcagtaaacttacgtaggaggcgagatttggtggatgtcaagtctagacatgatattctttatgtgcaattacagtacctctatgatactttgaaagattatatcaacgatgccttggggaatttggcagaatcttggtgcctcgatcaaaaacgaacgataacgatgttgcacgaacttagtaagatcagtccatcgagtatcgtgtctgaggtttacggtcgtccgatatctgcacagttgcatggtgatgtgttagctatctcgaaatgcatagaagttaatcagtcatccgttcagcttcataagagtatgcgggtcgtcgatgcgaagggattaaggagtgaaacggtgtgttataatcggcccttggtgacgtttagctttgtgaactccacgcctgaggttgtccctggtcagctagggttagataatgagattctgttgggtgatcataggacagaggaatgtgagatacctagtacaaagatatttctatctggaaatcatgcacacgtgtataccgattatacgcatacgaattcgacgcccatagaagacattgaggtattggatgcttttattagactaaagattgaccctctcgaaaatgctgattttaaactacttgatttatattcgccggacgaattgagtagagcaaacgttttcgatttagagaatattcttcgtgaatataactcatataagagcgcactatatactatagaagctaaaattgctactaatacgccgtcgtatgtcaatgggattaattcttttttacaagggcttggggctataggcactggattgggctcggttataagtgttacggcaggagcacttggggatattgtgggtggagtggtgtcttttttaaaaaatccattcgggggtggtctcatgttgattttagcgatagtagttgttgttataataattgtggttttcgttagacaaaaacatgtgcttagtaagcctattgacatgatgtttccttatgccaccaatccggtgactactgtgtccagtgttacggggaccactgccgtcaagacgcctagtgttaaagatgctgacgggggcacatctgttgcggtttcggaaaaagaggagggtatggctgacgtcagtggacaaataagtggtgatgaatattcacaagaagatgctttaaaaatgctcaaggccataaagtctttagacgagtcctacagaagaaaaccttcgtcttctgagtctcatgcctcaaaacctagtttgatagacaggatcaggtatagaggttataagagtgtaaatgtagaagaagcgtga

SEQ ID NO: 398 - protein, 830 aa, herpes simplex virus 6B
MSKMTVLFLAVFLMNSVLMIYCDSDNYIRAGYNHKYPFRICSIAKGTDLMRFDRDISCSPYKSNAKMSEGFFIIYKTNIETYTFPVRTYKNELTFQTSYRDVGVVYFLDRTVMGLAMPMYEANLVNSRAQCYSAVAIKRPDGTVFSAYHEDNNKNETLELFPLNFKSVTNKRFITTKEPYFARGPLWLYSTSTSLNCIVTEATAKAKYPFSYFALTTGEIVEGSPFFDGSNGKHFAEPLEKLTILENYTMIEDLMNGMNGATTLVRKIAFLEKGDTLFSWEIKEENESVCMLKHWTTVTHGLRAETDETYHFISKELTAAFVTPKDSLNLTDPKQTCIKNEFENIIKEVYMSDYNDTYSMNGSYQIFKTTGDLILIWQPLVQKSLMVLEQGSVNLRRRRDLVDVKSRHDILYVQLQYLYDTLKDYINDALGNLAESWCLDQKRTITMLHELSKISPSSIVSEVYGRPISAQLHGDVLAISKCIEVNQSSVQLHKSMRVVDAKGLRSETVCYNRPLVTFSFVNSTPEVVPGQLGLDNEILLGDHRTEECEIPSTKIFLSGNHAHVYTDYTHTNSTPIEDIEVLDAFIRLKIDPLENADFKLLDLYSPDELSRANVFDLENILREYNSYKSALYTIEAKIATNTPSYVNGINSFLQGLGAIGTGLGSVISVTAGALGDIVGGVVSFLKNPFGGGLMLILAIVVVVIIIVVFVRQKHVLSKPIDMMFPYATNPVTTVSSVTGTTAVKTPSVKDADGGTSVAVSEKEEGMADVSGQISGDEYSQEDALKMLKAIKSLDESYRRKPSSSESHASKPSLIDRIRYRGYKSVNVEEA

SEQ ID NO: 399 - DNA, 513 bp, herpes simplex virus 6B
  CDS (1)..(513)
gattatgtaaattatacatctgagaacattcggttgtgcacatctggttattcttatgtgtcaatattctgcccgttaccctgtcgtattttcgcgggaacgccatctccattttgtcgatatattacatcgttaaatatctccaccgcgagattatcaaataggatagccgctgaatccaccctccgaggcaaggactcgacctgttccactataaaattgcaatttttgcttattttatcaattattttaaaaaggtcgtttttcgtttcacagttctcaaaatcgtcttttatctcgtttaacgccgaattcattcccctctcagagtatacgcggacaaagcttcaatctacttattgtcgacgagagccactttataaagaaagacgcgttcagcacgattttaggtttcctgccccaagcatctaccaagatcctatttatatcttcgaccaattccggaaaccattcaacttcttttttaatgaagctgaacaactctccgtttga

SEQ ID NO: 400 - protein, 170 aa, herpes simplex virus 6B
DYVNYTSENIRLCTSGYSYVSIFCPLPCRIFAGTPSPFCRYITSLNISTARLSNRIAAESTLRGKDSTCSTIKLQFLLILSIILKRSFFVSQFSKSSFISFNAEFIPLSEYTRTKLQSTYCRREPLYKERRVQHDFRFPAPSIYQDPIYIFDQFRKPFNFFFNEAEQLSV

SEQ ID NO: 401 - DNA, 8878 bp, Artificial
  plasmid
ttaattaaggccgcagcttcctagataacttcgtatagcatacattatacgaagttatggatctcccgcccagcgtcttgtcattggcgaactcgaacacgcagatgcagtcggggcggcgcggtcccaggtccacttcgcatattaaggtgacacgcgcggcctcgaacacagctgcaggccatgagcgaaaaatacatcgtcacctgggacatgttgcagatccatgcacgtaaactcgcaagccgactgatgccttctgaacaatggaaaggcattattgccgtaagccgtggcggtctggtaccgggtgcgttactggcgcgtgaactgggtattcgtcatgtcgataccgtttgtatttccagctacgatcacgacaaccagcgcgagcttaaagtgctgaaacgcgcagaaggcgatggcgaaggcttcatcgttattgatgacctggtggataccggtggtactgcggttgcgattcgtgaaatgtatccaaaagcgcactttgtcaccatcttcgcaaaaccggctggtcgtccgctggttgatgactatgttgttgatatcccgcaagatacctggattgaacagccgtgggatatgggcgtcgtattcgtcccgccaatctccggtcgctaaccggtagcggatcatctagacccgggtaccgttaacttgtttattgcagcttataatggttacaaataaagcaatagcatcacaaatttcacaaataaagcatttttttcactgcattctagttgtggtttgtccaaactcatcaatgtatcttatcatgtctggatccccattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtaggctcgccgcagtcgagcgacggcgaagccctcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgagtttaaacatgcatagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaaatggccgcataacttcgtatagcatacattatacgaagttatctagcagatctgaattcgatatcaagctgcggccttaattaa

SEQ ID NO: 402 - DNA, 30 bp, Artificial
  primer
atgcggccgcgcgagtgataggtactttct

SEQ ID NO: 403 - DNA, 30 bp, Artificial
  primer
gcttaattaatatataagtccttcaatagc

SEQ ID NO: 404 - DNA, 30 bp, Artificial
  primer
gcttaattaacatgctctgcaatgcaagcc

SEQ ID NO: 405 - DNA, 30 bp, Artificial
  primer
atgcggccgcaaatagcctttgctcatagc

What is claimed is:

1. A method for gene transfer into T lymphoid cells comprising infecting a T lymphoid cell with a recombinant herpesvirus comprising:
   a BAC vector sequence, wherein the BAC vector sequence is inserted into a non-essential region of a herpesvirus genome, and wherein the non-essential region is a non-essential region of HHV-7 or HHV-6.

2. A method for gene transfer comprising infecting a T lymphoid cell with a vector comprising:
   a human herpesvirus genome comprising an essential gene and a non-essential region, and
   a BAC vector sequence linked to the herpesvirus genome, wherein the BAC vector sequence is inserted into a non-essential region of the herpesvirus genome, and wherein the non-essential region is a non-essential region of HHV-7 or HHV-6.

* * * * *